(12) United States Patent
Seamon et al.

(10) Patent No.: US 11,807,877 B1
(45) Date of Patent: Nov. 7, 2023

(54) CRISPR/CAS ACTIVITY ASSAYS AND COMPOSITIONS THEREOF

(71) Applicant: National Technology & Engineering Solutions of Sandia, LLC, Albuquerque, NM (US)

(72) Inventors: Kyle Jeffrey Seamon, Livermore, CA (US); Brooke Nicole Harmon, Livermore, CA (US); Joseph S. Schoeniger, Oakland, CA (US); Yooli Kim Light, Pleasanton, CA (US)

(73) Assignee: National Technology & Engineering Solutions of Sandia, LLC, Albuquerque, NM (US)

(*) Notice: Subject to any disclaimer, the term of this patent is extended or adjusted under 35 U.S.C. 154(b) by 1266 days.

(21) Appl. No.: 16/360,946

(22) Filed: Mar. 21, 2019

Related U.S. Application Data

(60) Provisional application No. 62/646,780, filed on Mar. 22, 2018.

(51) Int. Cl.
| | | |
|---|---|---|
| C07H 21/04 | (2006.01) | |
| C12N 9/22 | (2006.01) | |
| G01N 33/542 | (2006.01) | |
| C12N 15/11 | (2006.01) | |
| G01N 33/573 | (2006.01) | |
| C12Q 1/6818 | (2018.01) | |

(52) U.S. Cl.
CPC .............. *C12N 9/22* (2013.01); *C12N 15/11* (2013.01); *C12N 15/111* (2013.01); *C12Q 1/6818* (2013.01); *G01N 33/542* (2013.01); *G01N 33/573* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | |
|---|---|---|
| 6,188,812 B1 | 2/2001 | Kao et al. |
| 6,210,986 B1 | 4/2001 | Arnold et al. |
| 6,277,257 B1 | 8/2001 | Paul et al. |
| 6,287,440 B1 | 9/2001 | Arnold et al. |
| 6,428,666 B1 | 8/2002 | Singh et al. |
| 6,495,015 B1 | 12/2002 | Schoeniger et al. |
| 6,572,749 B1 | 6/2003 | Paul et al. |
| 6,843,272 B2 | 1/2005 | Schoeniger et al. |
| 6,960,285 B2 | 11/2005 | Schoeniger et al. |
| 7,022,287 B2 | 4/2006 | Schoeniger et al. |
| 7,368,290 B2 | 5/2008 | Kruppa et al. |
| 9,024,111 B1 | 5/2015 | Schoeniger et al. |
| 9,803,238 B1 | 10/2017 | Koh et al. |
| 10,267,788 B1 | 4/2019 | Schoeniger et al. |
| 2015/0211058 A1 | 7/2015 | Carstens |
| 2016/0090603 A1 | 3/2016 | Carnes et al. |
| 2018/0028686 A1 | 2/2018 | Brinker et al. |
| 2018/0049984 A1 | 2/2018 | Brinker et al. |
| 2018/0274017 A1 | 9/2018 | Abudayyeh et al. |
| 2018/0298445 A1 | 10/2018 | Abudayyeh et al. |
| 2018/0305773 A1 | 10/2018 | Abudayyeh et al. |
| 2018/0340218 A1 | 11/2018 | Abudayyeh et al. |
| 2019/0062724 A1 | 2/2019 | Hsu et al. |

FOREIGN PATENT DOCUMENTS

| | | |
|---|---|---|
| WO | WO 2018/064352 A1 | 4/2018 |
| WO | WO 2018/064371 A1 | 4/2018 |

OTHER PUBLICATIONS

Anders, Carolin, and Martin Jinek. "In vitro enzymology of Cas9." Methods in enzymology. vol. 546. Academic Press, 2014. 1-20.*
Anders et al. ("In vitro enzymology of Cas9." Methods in enzymology. vol. 546. Academic Press, 2014. 1-20).*
Peng et al. "Potential pitfalls of CRISPR/Cas9-mediated genome editing." The FEBS journal 283.7 (2016): 1218-1231, see pp. 1222-1223).*
Gasiunas et al. "A catalogue of biochemically diverse CRISPR-Cas9 orthologs." Nature communications 11.1 (2020): 1-10).*
Peng, Jingyu, et al. "High-throughput screens in mammalian cells using the CRISPR-Cas9 system." The FEBS journal 282.11 (2015): 2089-2096.).*
U.S. Appl. No. 15/008,285, filed Jan. 27, 2016, Meagher et al.
U.S. Appl. No. 15/204,804, filed Jul. 7, 2016, Negrete et al.
U.S. Appl. No. 15/717,524, filed Sep. 27, 2017, Koh et al.
U.S. Appl. No. 16/219,779, filed Dec. 13, 2018, Negrete et al.
U.S. Appl. No. 16/443,316, filed Jun. 17, 2019, Negrete et al.
U.S. Appl. No. 15/951,977, filed Apr. 12, 2018, Bird et al.
Abudayyeh OO et al., "C2c2 is a single-component programmable RNA-guided RNA-targeting CRISPR effector," *Science* 2016;353:aaf5573 (9 pp.).
Abudayyeh OO et al., "RNA targeting with CRISPR-Cas13," *Nature* 2017;550:280-4.
Burstein D, "New CRISPR-Cas systems from uncultivated microbes," *Nature* 2017;542:237-41.
Cebrian-Serrano A et al., "CRISPR-Cas orthologues and variants: optimizing the repertoire, specificty and delivery of genome engineering tools," *Mamm. Genome* 2017;28:(7-8):247-61.
Chen JS et al., "CRISPR-Cas12a target binging unleashes indiscriminate single-stranded DNase activity," *Science* 2018;360:436-9.
Chen JS et al., "Enhanced proofreading governs CRISPR-Cas9 targeting accuracy," *Nature* 2017;550(7676):407-10.
Cho SW et al., "Targeted genome engineering in human cells with the Cas9 RNA-guided endonuclease," *Nat. Biotechnol.* 2013;31(3):230-2.

(Continued)

*Primary Examiner* — Kimberly Chong
(74) *Attorney, Agent, or Firm* — Helen S. Baca; Samantha Updegraff; Eschweiler & Potashnik LLC

(57) ABSTRACT

The present invention relates, in part, to methods for detecting nuclease activity, such as the activity of Cas nucleases. Also described herein are compositions for conducting assays, as well as methods for conducting assays in the presence of test compounds.

24 Claims, 83 Drawing Sheets

Specification includes a Sequence Listing.

(56) References Cited

OTHER PUBLICATIONS

Cinesi C et al., "Contracting CAG/CTG repeats usng the CRISPR-Cas9 nickase," *Nat. Commun.* 2016;7:13272 (10 pp.).
Cong L et al., "Multiplex genome engineering using CRISPR/Cas systems," *Science* 2013;339:819-23.
Cox DBT et al., "RNA editing with CRISPR-Cas13," *Science* 2017;358:1019-27.
Ding Q et al., "Permanent alteration of PCSK9 with in vivo CRISPR-Cas9 genome editing," *Circ. Res.* 2014;115(5):488-92.
Doench JG et al., "Optimized sgRNA design to maximize activity and minimize off-target effects of CRISPR-Cas9," *Nat. Biotechnol.* 2015;34(2):184-91.
Dugar G et al., "CRISPR RNA-dependent binding and cleavage of endogenous RNAs by the *Campylobacter jejuni* Cas9," *Mol. Cell.* 2018;69(5):893-905.
East-Seletsly A et al., "Two distinct RNase activities of CRISPS-C2c2 enable guide-RNA processing and RNA detection," *Nature* 2016;538:270-3.
Fu Y et al., "Improving CRISPR-Cas nuclease specificity using truncated guide RNAs," *Nat. Biotechnol.* 2014;32(3):279-84.
Gasiunas G et al., "Cas9-crRNA ribonucleoprotein complex mediates specific DNA cleavage for adaptive immunity in bacteria," *Proc. Nat'l Acad. Sci.* 2012;109:E2579-86.
Gratz SJ et al., "Genome engineering of *Drosophila* with the CRISPR RNA-guided Cas9 nuclease," *Genetics* 2013;194(4):1029-35.
Gulei D et al., "CRISPR-based RNA editing: diagnostic applications and therapeutic options," *Expert Rev. Molec. Diagnostics* 2019;19:83-8.
Harrington LB et al., "A thermostable Cas9 with increased lifetime in human plasma," *Nat. Commun.* 2017;8:1424 (8 pp.).
Harrington LB et al., "Programmed DNA destruction by miniature CRISPR-Cas14 enzymes," *Science* 2018; 362 839-42.
Harrington LB et al., "A broad-spectrum inhibitor of CRISPR-Cas9," *Cell* 2017;170(6):1224-33.
Hirano H et al., "Structure and engineering of *Francisella novicida* Cas9," *Cell* 2016;164:950-61.
Hou Z et al., "Efficient genome engineering in human pluripotent stem cells using Cas9 from *Neisseria meningitidis,*" *Proc. Nat'l Acad. Sci.* 2013;110:15644-9.
Hsu PD et al., "DNA targeting specificity of RNA-guided Cas9 nucleases," *Nat. Biotechnol.* 2013;31(9):827-32.
Hu JH et al., "Evolved Cas9 variants with broad PAM compatibility and high DNA specificity," *Nature* 2018;556(7699):57-63.
Huang M, "Clustered regularly interspaced short palindromic repeats/Cas9 triggered isothermal amplification for site-specific nucleic acid detection," *Anal. Chem.* 2018;90(3):2193-200.
Huang M et al., "Clustered Regularly Interspaced Short Palindromic Repeats/Cas9 triggered isothermal amplification for site-specific nucleic acid detection," *Anal Chem.* 2018;90(3):2193-200.
Hwang WY et al., "Efficient genome editing in zebrafish using a CRISPR-Cas system," *Nat Biotechnol.* 2013;31(3):227-9.
Jinek M et al., "A programmable dual-RNA-guided DNA endonuclease in adaptive bacterial immunity," *Science* 2012;337:816-21.
Jinek M et al., "RNA-programmed genome editing in human cells," *eLife* 2013;2:e00471 (9 pp.).
Karvelis T et al., "Rapid characterization of CRISPR-Cas9 protospacer adjacent motif sequence elements," *Genome Biol.* 2015;16(1):253 (13 pp.).
Kim E et al., "In vivo genome editing with a small Cas9 orthologue derived from *Campylobacter jejuni,*" *Nat. Commun.* 2017;8:14500 (12 pp.).
Kleinstiver BP et al., "Broadening the targeting range of *Staphylococcus aureus* CRISPR-Cas9 by modifying PAM recognition," *Nat. Biotechnol.* 2015:33:1293-8.
Kleinstiver BP et al., "Engineered CRISPR-Cas12a variants with increased activities and improved targeting ranges for gene, epigenetic and base editing," *Nat. Biotechnol.* 2019;37(3):276-82.
Kleinstiver BP et al., "Engineered CRISPR-Cas9 nucleases with altered PAM specificities," *Nature* 2015;523:481-5.
Kleinstiver BP et al., "Genome-wide specificities of CRISPR-Cas Cpf1 nucleases in human cells," *Nat. Biotechnol.* 2016;34:869-74.
Kleinstiver BP et al., "High-fidelity CRISPR-Cas9 nucleases with no detectable genome-wide off-target effects," *Nature* 2016;529:490-5.
Konermann S et al., "Transcriptome engineering with RNA-targeting type VI-D CRISPR effectors," *Cell* 2018;173:665-76.
Koo T et al., "Selective disruption of an oncogenic mutant allele by CRISPR/Cas9 induces efficient tumor regression," *Nucleic Acids Res.* 2017;45(13):7897-908.
Koonin EV et al., "Diversity, classification and evolution of CRISPR-Cas systems," *Curr. Op. Microbiol.* 2017;37:67-78.
Kulcsár PI et al., "Crossing enhanced and high fidelity SpCas9 nucleases to optimize specificity and cleavage," *Genome Biol.* 2017;18(1):190 (17 pp.).
Leenay RT et al., "Deciphering, communicating, and engineering the CRISPR PAM," *J. Mol. Biol.* 2017;429(2):177-91.
Li B et al., "Synthetic oligonucleotides inhibit CRISPR-Cpf1-mediated genome editing," *Cell Rep.* 2018;25:3262-72.
Liu JJ et al., "CasX enzymes comprise a distinct family of RNA-guided genome editors," *Nature* 2019;566:218-23.
Liu W et al., "In vitro evaluation of CRISPR/Cas9 function by an electrochemiluminescent assay," *Anal. Chem.* 2016;68(17):8369-74.
Liu C et al., "Delivery strategies of the CRISPR-Cas9 gene-editing system for therapeutic applications," *J. Control. Release* 2017;266:17-26.
Liu KI et al., "A chemical-inducible CRISPR-Cas9 system for rapid control of genome editing," *Nat. Chem. Biol.* 2016;12(11):980-7.
Long C et al., "Prevention of muscular dystrophy in mice by CRISPR/Cas9-mediated editing of germline DNA," *Science* 2014;345(6201):1184-8.
Makarova KS et al., "Evolution and classification of the CRISPR-Cas systems," *Nat. Rev. Microbiol.* 2011;9:467-77.
Mali P et al., "RNA-guided human genome engineering via Cas9," *Science* 2013;339(6121):823-6.
Marshall R et al., "Rapid and scalable characterization of CRISPR technologies using an *E. coli* cell-free transcription-translation system," *Mol. Cell.* 2018;69(1):148-57.
Mekler V et al., "Kinetics of the CRISPR-Cas9 effector complex assembly and the role of 3'-terminal segment of guide RNA," *Nucleic Acids Res.* 2016;44(5):2837-45.
Mekler V et al., "Mechanism of duplex DNA destabilization by RNA-guided Cas9 nuclease during target interrogation," *Proc. Nat'l Acad. Sci. USA* 2017;114(21):5443-8.
Moreno AM et al., "Therapeutic genome engineering via CRISPR-Cas systems," *WIREs Syst. Biol. Med.* 2017;9:e1380 (14 pp.).
Murugan K et al., "The revolution continues newly discovered systems expand the Crispr-Cas toolkit," *Mol. Cell.* 2017;68:15-25.
Murovec J et al., "New variants of CRISPR RNA-guided genome editing enzymes," *Plant Biotechnol. J.* 2017;15:917-26.
Nakayama T et al., "Simple and efficient CRISPR/Cas9-mediated targeted mutagenesis in *Xenopus tropicalis,*" *Genesis* 2013;51(12):835-43.
Nelson CE et al., "In vivo genome editing improves muscle function in a mouse model of Duchenne muscular dystrophy," *Science* 2016;351(6271):403-7.
Nishimasu H et al., "Engineered CRISPR-Cas9 nuclease with expanded targeting space," *Science* 2018;361:1259-62.
Oakes BL et al., "Profiling of engineering hotspots identifies an allosteric CRISPR-Cas9 switch," *Nat. Biotechnol.* 2016;34(6):646-51.
Ohmori T et al., "CRISPR/Cas9-mediated genome editing via postnatal administration of AAV vector cures haemophilia B mice," *Sci. Rep.* 2017;7(1):4159 (11 pp.).
Pattanayak V et al., "High-throughput profiling of off-target DNA cleavage reveals RNA-programmed Cas9 nuclease specificity," *Nat. Biotechnol.* 2013;31(9):839-43.
Pawluk A et al., "Naturally occurring off-switches for CRISPR-Cas9," *Cell* 2016;167(7):1829-38.

(56) References Cited

OTHER PUBLICATIONS

Pegram LM et al., "Why Hofmeister effects of many salts favor protein folding but not DNA helix formation," *Proc. Nat'l Acad. Sci. USA* 2010;107(17):7716-21.
Phaneuf CR et al., "Ultrasensitive multi-species detection of CRISPR-Cas9 by a portable centrifugal microfluidic platform," *Anal. Methods* 2019;11(5):559-65.
Pinto BS et al., "Impeding transcription of expanded microsatellite repeats by deactivated Cas9," *Mol. Cell.* 2017;68(3):479-90.
Ran FA et al., "In vivo genome editing using *Staphylococcus aureus* Cas9," *Nature* 2015;520(7546):186-91.
Rauch BJ et al., "Inhibition of CRISPR-Cas9 with bacteriophage proteins," *Cell* 2017;168(1-2):150-8.
Rose JC et al., "Rapidly inducible Cas9 and DSB-ddPCR to probe editing kinetics," *Nat. Methods* 2017;14(9):891-6.
Schneider CA et al., "NIH Image to ImageJ: 25 years of image analysis," *Nat. Methods* 2012;9(7):671-5.
Scott DE et al., "Small molecules, big targets: drug discovery faces the protein-protein interaction challenge," *Nat. Rev. Drug Discov.* 2016;15(8):533-50.
Seamon KJ et al., "Versatile high-throughput fluorescence assay for monitoring Cas9 activity," *Anal. Chem.* 2018;90(11):6913-21.
Seiple LA et al., "Potent inhibition of human apurinic/apyrimidinic endonuclease 1 by arylstibonic acids," *Mol. Pharmacol.* 2008;73(3):669-77.
Senturk S et al., "Rapid and tunable method to temporally control gene editing based on conditional Cas9 stabilization," *Nat. Commun.* 2017;8:14370 (10 pp.).
Shin J et al., "Disabling Cas9 by an anti-CRISPR DNA mimic," *Sci. Adv.* 2017;3:(7):e1701620 (9 pp.).
Singh D et al., "Real-time observation of DNA recognition and rejection by the RNA-guided endonuclease Cas9," *Nat. Commun.* 2016;7:12778 (8 pp.).
Slaymaker IM et al., "Rationally engineered Cas9 nucleases with improved specificity," *Science* 2016;351(6268)84-8.
Smargon AA et al., "Cas13b is a type VI-B CRISPR-associated RNA-guided RNase differentially regulated by accessory proteins Csx27 and Csx28," *Mol. Cell* 2017;65(4):618-30.
Sternberg SH et al., "Conformational control of DNA target cleavage by CRISPR-Cas9," *Nature* Nov. 5, 2015;527(7576):110-3.
Sternberg SH et al., "DNA interrogation by the CRISPR RNA-guided endonuclease Cas9," *Nature* 2014;507:(7490):62-7.
Strecker J et al., "Engineering CRISPR-Cas12b for human genome editing," *Nat. Commun.* 2019;10:212 (8 pp.).
Strutt SC et al., "RNA-dependent RNA targeting by CRISPR-Cas9," *eLife* 2018;7:e32724 (17 pp.).
Suzuki K et al., "In vivo genome editing via CRISPR/Cas9 mediated homology-independent targeted integration," *Nature* 2016;540:(7631):144-9.
Tabebordbar M et al., "In vivo gene editing in dystrophic mouse muscle and muscle stem cells," *Science* 2016;351(6271):407-11.
Tang Y et al., "Class 2 CRISPR/Cas: an expanding biotechnology toolbox for and beyond genome editing," *Cell Biosci.* 2017;8:59 (13 pp.).
Teng F et al., "Repurposing CRISPR-Cas12b for mammalian genome engineering," *Cell Discovery* 2018;4:63 (15 pp.).
Tsai SQ et al., "GUIDE-seq enables genome-wide profiling of off-target cleavage by CRISPR-Cas nuclease," *Nat. Biotechnol.* 2015;33(2):187-97.
Tu Z et al., "Promoting Cas9 degradation reduces mosaic mutations in non-human primate embryos," *Sci. Rep.* 2017;7:42081 (11 pp.).
Wang H et al., "One-step generation of mice carrying mutations in multiple genes by CRISPR/Cas-mediated genome engineering," *Cell* 2013;153(4):910-8.
Wu Y et al., "Correction of a genetic disease in mouse via use of CRISPR-Cas9," *Cell Stem Cell* 2013;13(6):659-62.
Wu Z et al., "Effect of genome size on AAV vector packaging," *Mol. Ther.* 2010;18(1):80-6.
Xia H et al., "Developement of single-tube nested real-time PCR assays with long internally quenched probes for detection of norovirus genogroup II," *BioTechniques* 2016;60(1):28-34.
Yamano T et al., "Crystal structure of Cpf1 in complex with guide RNA and target RNA," *Cell* 2016;165:949-62.
Yang Y et al., "A dual AAV system enables the Cas9-mediated correction of a metabolic liver disease in newborn mice," *Nat. Biotechnol.* 2016;34(3):334-8.
Yang H et al., "Inhibition mechanism of an anti-CRISPR suppressor AcrIIA4 targeting SpyCas9," *Mol. Cell.* 2017;67(1):117-27.
Yao X et al., "CRISPR/Cas9-mediated precise targeted integration in vivo using a double cut donor with short homology arms," *EBioMedicine* 2017;20:19-26.
Zetsche B et al., "Cpf1 is a single RNA-guided endonuclease of a class 2 CRISPR-Cas system," *Cell* 2015;163:759-71.
Zhang K et al., "Cas9 cleavage assay for pre-screening of sgRNAs using nicking triggered isothermal amplification," *Chem. Sci.*, 2016;7(8):4951-7.
Zhang JH et al., "A simple statistical parameter for use in evaluation and validation of high throughput screening assay," *J. Biomol. Screen.* 1999;4(2):67-73.
Zhang JP et al., "Different effects of sgRNA length on CRISPR-mediated gene knockout efficiency," *Sci. Rep.* 2016;6:28566 (10 pp.).
Zhou W et al., "A CRISPR-Cas9-triggered strand displacement amplification method for ultrasensitive DNA detection," *Nat. Commun.* 2018;9:5012 (11 pp.).
Zuris JA et al., "Cationic lipid-mediated delivery of proteins enables efficient protein-based genome editing in vitro and in vivo," *Nat. Biotechnol.* 2015;33(1):73-80.

\* cited by examiner

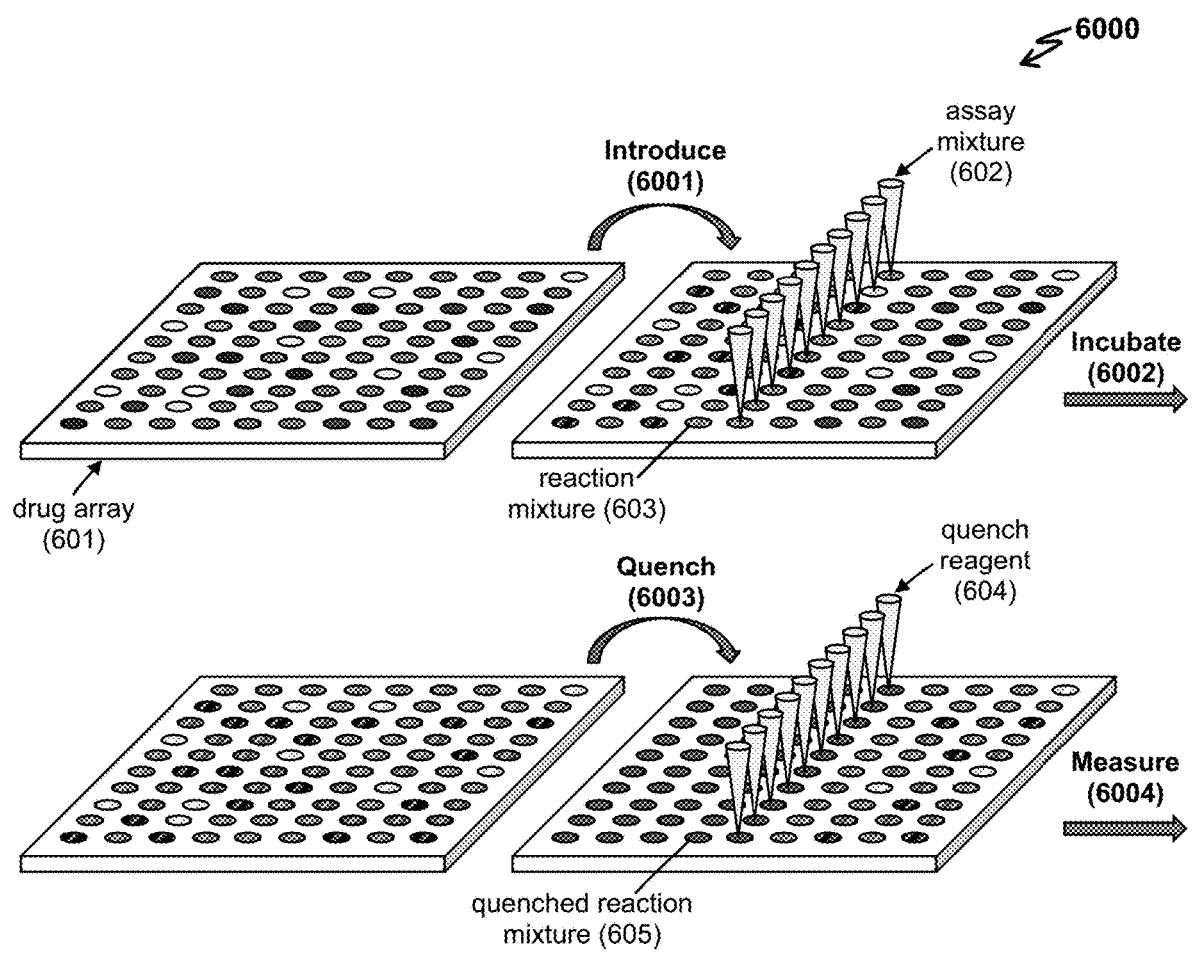
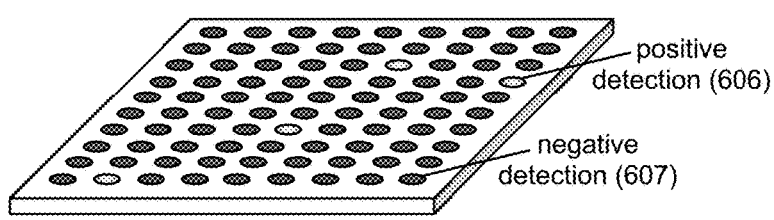
FIG. 6

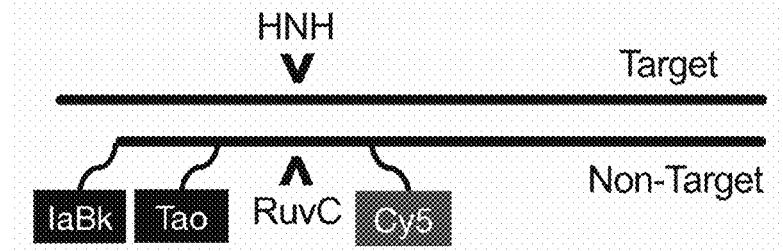
FIG. 7A
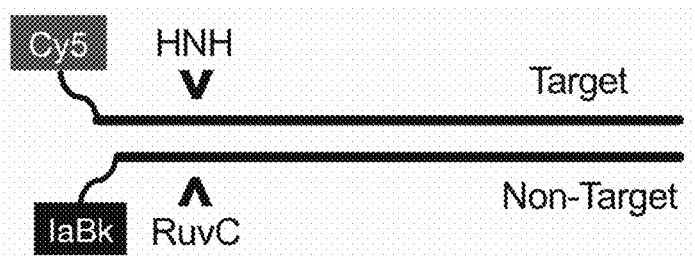
FIG. 7B
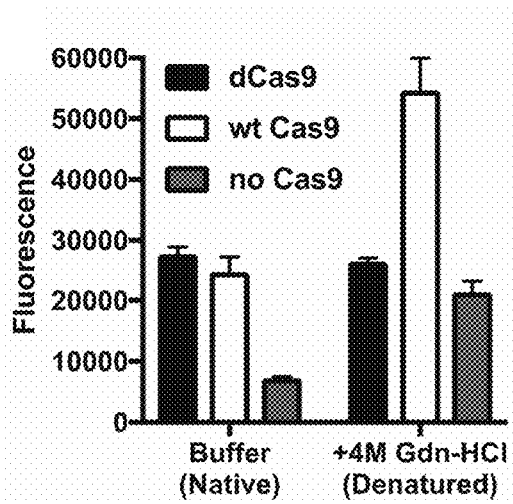 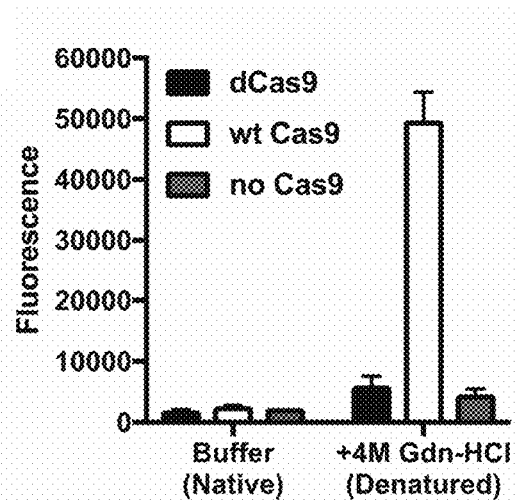
FIG. 7C          FIG. 7D

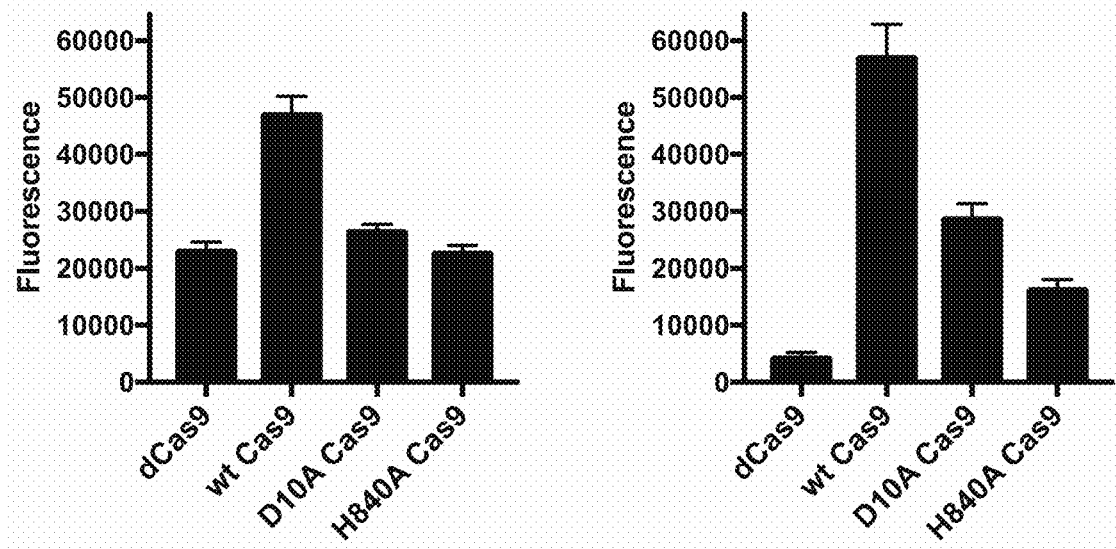
FIG. 7E  FIG. 7F
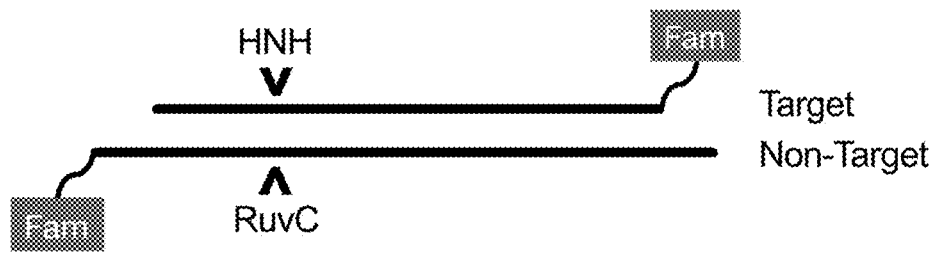
FIG. 8A
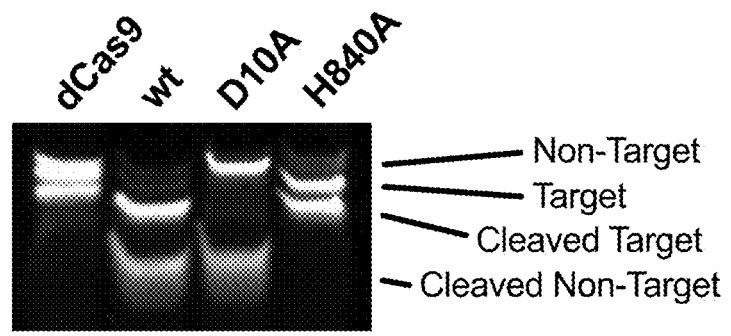
FIG. 8B

*S. pyogenes* (Spy):
```
                              v
5'-GCACAGCAGAAATCTCTGCTGACGCATAAAGATGAGACGCTGGAGTA-IaBlk(Non-target)
3'-CGTGTCGTCTTTAGAGACGACTGCGTATTTCTACTCTGCGACCTCATGT-Cy5(Target)
                              ^
```
*S. aureus* (Sau):
```
                              v
5'-GCACAGCAGAAATCTCTGCTGACGCATAAAGATGAGACGCTGGAGTA-IaBlk(Non-target)
3'-CGTGTCGTCTTTAGAGACGACTGCGTATTTCTACTCTGCGACCTCATGT-Cy5(Target)
                              ^
```
*C. jejuni* (Cje):
```
                              v
5'-GCACAGCAGAAATCTCTGCTGACGCATAAAGATGAGACGCGTGAACACG-IaBlk(Non-Target)
3'-CGTGTCGTCTTTAGAGACGACTGCGTATTTCTACTCTGCGCACTTGTGCCT-Cy5(Target)
```

FIG. 9

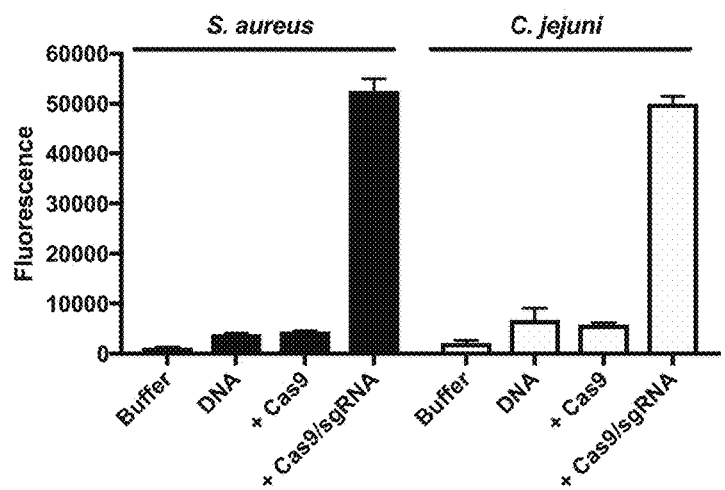

FIG. 10

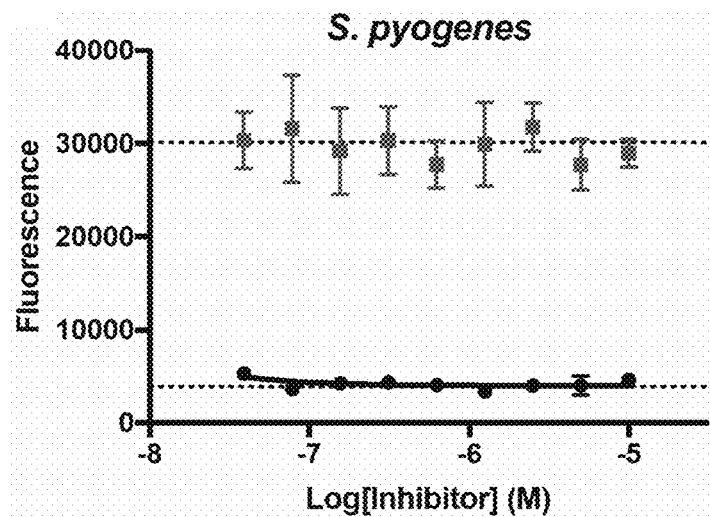

FIG. 11A

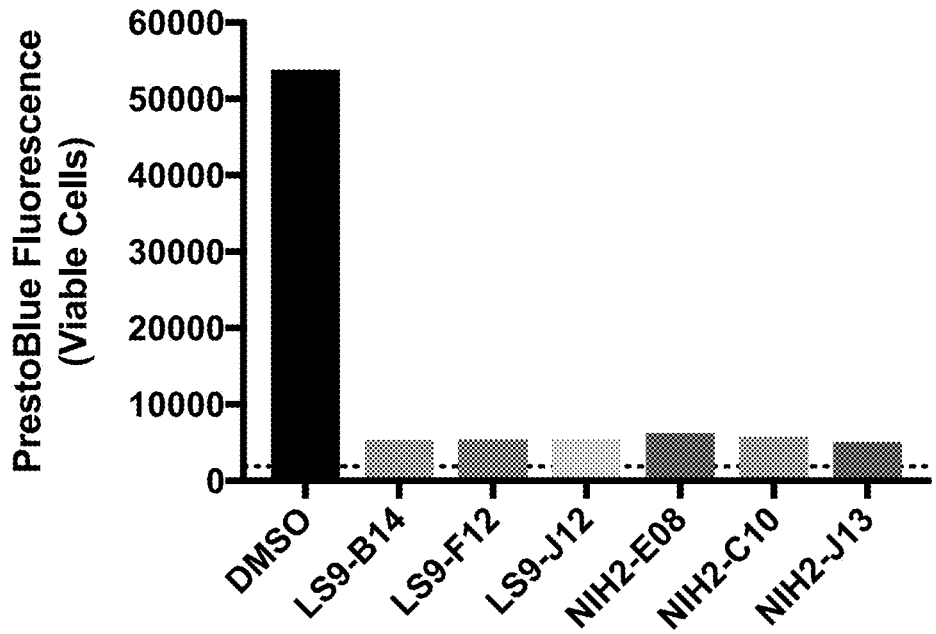

FIG. 14

```
Wt SauCas9 (SEQ ID NO:100)
   1 MGKRNYILGL DIGITSVGYG IIDYETRDVI DAGVRLFKEA NVENNEGRRS KRGARRLKRR
  61 RRHRIQRVKK LLFDYNLLTD HSELSGINPY EARVKGLSQK LSEEEFSAAL LHLAKRRGVH
 121 NVNEVEEDTG NELSTKEQIS RNSKALEEKY VAELQLERLK KDGEVRGSIN RFKTSDYVKE
 181 AKQLLKVQKA YHQLDQSFID TYIDLLETRR TYYEGPGEGS PFGWKDIKEW YEMLMGHCTY
 241 FPEELRSVKY AYNADLYNAL NDLNNLVITR DENEKLEYYE KFQIIENVFK QKKKPTLKQI
 301 AKEILVNEED IKGYRVTSTG KPEFTNLKVY HDIKDITARK EIIENAELLD QIAKILTIYQ
 361 SSEDIQEELT NLNSELTQEE IEQISNLKGY TGTHNLSLKA INLILDELWH TNDNQIAIFN
 421 RLKLVPKKVD LSQQKEIPTT LVDDFILSPV VKRSFIQSIK VINAIIKKYG LPNDIIIELA
 481 REKNSKDAQK MINEMQKRNR QTNERIEEII RTTGKENAKY LIEKIKLHDM QEGKCLYSLE
 541 AIPLEDLLNN PFNYEVDHII PRSVSFDNSF NNKVLVKQEE NSKKGNRTPF QYLSSSDSKI
 601 SYETFKKHIL NLAKGKGRIS KTKKEYLLEE RDINRFSVQK DFINRNLVDT RYATRGLMNL
 661 LRSYFRVNNL DVKVKSINGG FTSFLRRKWK FKKERNKGYK HHAEDALIIA NADFIFKEWK
 721 KLDKAKKVME NQMFEEKQAE SMPEIETEQE YKEIFITPHQ IKHIKDFKDY KYSHRVDKKP
 781 NRELINDTLY STRKDDKGNT LIVNNLNGLY DKDNDKLKKL INKSPEKLLM YHHDPQTYQK
 841 LKLIMEQYGD EKNPLYKYYE ETGNYLTKYS KKDNGPVIKK IKYYGNKLNA HLDITDDYPN
 901 SRNKVVKLSL KPYRFDVYLD NGVYKFVTVK NLDVIKKENY YEVNSKCYEE AKKLKKISNQ
 961 AEFIASFYNN DLIKINGELY RVIGVNNDLL NRIEVNMIDI TYREYLENMN DKRPPRIIKT
1021 IASKTQSIKK YSTDILGNLY EVKSKKHPQI IKKG
```

FIG. 15A

```
dSauCas9   (SEQ ID NO:101)
        1  MGKRNYILGL AIGITSVGYG IIDYETRDVI DAGVRLFKEA NVENNEGRRS KRGARRLKRR
       61  RRHRIQRVKK LLFDYNLLTD HSELSGINPY EARVKGLSQK LSEEEFSAAL LHLAKRRGVH
      121  NVNEVEEDTG NELSTKEQIS RNSKALEEKY VAELQLERLK KDGEVRGSIN RFKTSDYVKE
      181  AKQLLKVQKA YHQLDQSFID TYIDLLETRR TYYEGPGEGS PFGWKDIKEW YEMLMGHCTY
      241  FPEELRSVKY AYNADLYNAL NDLNNLVITR DENEKLEYYE KFQIIENVFK QKKKPTLKQI
      301  AKEILVNEED IKGYRVTSTG KPEFTNLKVY HDIKDITARK EIIENAELLD QIAKILTIYQ
      361  SSEDIQEELT NLNSELTQEE IEQISNLKGY TGTHNLSLKA INLILDELWH TNDNQIAIFN
      421  RLKLVPKKVD LSQQKEIPTT LVDDFILSPV VKRSFIQSIK VINAIIKKYG LPNDIIIELA
      481  REKNSKDAQK MINEMQKRNR QTNERIEEII RTTGKENAKY LIEKIKLHDM QEGKCLYSLE
      541  AIPLEDLLNN PFNYEVDHII PRSVSFDNSF NNKVLVKQEE ASKKGNRTPF QYLSSSDSKI
      601  SYETFKKHIL NLAKGKGRIS KTKKEYLLEE RDINRFSVQK DFINRNLVDT RYATRGLMNL
      661  LRSYFRVNNL DVKVKSINGG FTSFLRRKWK FKKERNKGYK HHAEDALIIA NADFIFKEWK
      721  KLDKAKKVME NQMFEEKQAE SMPEIETEQE YKEIFITPHQ IKHIKDFKDY KYSHRVDKKP
      781  NRELINDTLY STRKDDKGNT LIVNNLNGLY DKDNDKLKKL INKSPEKLLM YHHDPQTYQK
      841  LKLIMEQYGD EKNPLYKYYE ETGNYLTKYS KKDNGPVIKK IKYYGNKLNA HLDITDDYPN
      901  SRNKVVKLSL KPYRFDVYLD NGVYKFVTVK NLDVIKKENY YEVNSKCYEE AKKLKKISNQ
      961  AEFIASFYNN DLIKINGELY RVIGVNNDLL NRIEVNMIDI TYREYLENMN DKRPPRIIKT
     1021  IASKTQSIKK YSTDILGNLY EVKSKKHPQI IKKG
```

FIG. 15B

```
SpyCas9    (SEQ ID NO:102)
        1  MDKKYSIGLD IGTNSVGWAV ITDEYKVPSK KFKVLGNTDR HSIKKNLIGA LLFDSGETAE
       61  ATRLKRTARR RYTRRKNRIC YLQEIFSNEM AKVDDSFFHR LEESFLVEED KKHERHPIFG
      121  NIVDEVAYHE KYPTIYHLRK KLVDSTDKAD LRLIYLALAH MIKFRGHFLI EGDLNPDNSD
      181  VDKLFIQLVQ TYNQLFEENP INASGVDAKA ILSARLSKSR RLENLIAQLP GEKKNGLFGN
      241  LIALSLGLTP NFKSNFDLAE DAKLQLSKDT YDDDLDNLLA QIGDQYADLF LAAKNLSDAI
      301  LLSDILRVNT EITKAPLSAS MIKRYDEHHQ DLTLLKALVR QQLPEKYKEI FFDQSKNGYA
      361  GYIDGGASQE EFYKFIKPIL EKMDGTEELL VKLNREDLLR KQRTFDNGSI PHQIHLGELH
      421  AILRRQEDFY PFLKDNREKI EKILTFRIPY YVGPLARGNS RFAWMTRKSE ETITPWNFEE
      481  VVDKGASAQS FIERMTNFDK NLPNEKVLPK HSLLYEYFTV YNELTKVKYV TEGMRKPAFL
      541  SGEQKKAIVD LLFKTNRKVT VKQLKEDYFK KIECFDSVEI SGVEDRFNAS LGTYHDLLKI
      601  IKDKDFLDNE ENEDILEDIV LTLTLFEDRE MIEERLKTYA HLFDDKVMKQ LKRRRYTGWG
      661  RLSRKLINGI RDKQSGKTIL DFLKSDGFAN RNFMQLIHDD SLTFKEDIQK AQVSGQGDSL
      721  HEHIANLAGS PAIKKGILQT VKVVDELVKV MGRHKPENIV IEMARENQTT QKGQKNSRER
      781  MKRIEEGIKE LGSQILKEHP VENTQLQNEK LYLYYLQNGR DMYVDQELDI NRLSDYDVDH
      841  IVPQSFLKDD SIDNKVLTRS DKNRGKSDNV PSEEVVKKMK NYWRQLLNAK LITQRKFDNL
      901  TKAERGGLSE LDKAGFIKRQ LVETRQITKH VAQILDSRMN TKYDENDKLI REVKVITLKS
      961  KLVSDFRKDF QFYKVREINN YHHAHDAYLN AVVGTALIKK YPKLESEFVY GDYKVYDVRK
     1021  MIAKSEQEIG KATAKYFFYS NIMNFFKTEI TLANGEIRKR PLIETNGETG EIVWDKGRDF
     1081  ATVRKVLSMP QVNIVKKTEV QTGGFSKESI LPKRNSDKLI ARKKDWDPKK YGGFDSPTVA
     1141  YSVLVVAKVE KGKSKKLKSV KELLGITIME RSSFEKNPID FLEAKGYKEV KKDLIIKLPK
     1201  YSLFELENGR KRMLASAGEL QKGNELALPS KYVNFLYLAS HYEKLKGSPE DNEQKQLFVE
     1261  QHKHYLDEII EQISEFSKRV ILADANLDKV LSAYNKHRDK PIREQAENII HLFTLTNLGA
     1321  PAAFKYFDTT IDRKRYTSTK EVLDATLIHQ SITGLYETRI DLSQLGGD
```

FIG. 15C

```
dSpyCas9 (D10A,H840A) (SEQ ID NO:103)
    1 MDKKYSIGLA IGTNSVGWAV ITDEYKVPSK KFKVLGNTDR HSIKKNLIGA LLFDSGETAE
   61 ATRLKRTARR RYTRRKNRIC YLQEIFSNEM AKVDDSFFHR LEESFLVEED KKHERHPIFG
  121 NIVDEVAYHE KYPTIYHLRK KLVDSTDKAD LRLIYLALAH MIKFRGHFLI EGDLNPDNSD
  181 VDKLFIQLVQ TYNQLFEENP INASGVDAKA ILSARLSKSR RLENLIAQLP GEKKNGLFGN
  241 LIALSLGLTP NFKSNFDLAE DAKLQLSKDT YDDDLDNLLA QIGDQYADLF LAAKNLSDAI
  301 LLSDILRVNT EITKAPLSAS MIKRYDEHHQ DLTLLKALVR QQLPEKYKEI FFDQSKNGYA
  361 GYIDGGASQE EFYKFIKPIL EKMDGTEELL VKLNREDLLR KQRTFDNGSI PHQIHLGELH
  421 AILRRQEDFY PFLKDNREKI EKILTFRIPY YVGPLARGNS RFAWMTRKSE ETITPWNFEE
  481 VVDKGASAQS FIERMTNFDK NLPNEKVLPK HSLLYEYFTV YNELTKVKYV TEGMRKPAFL
  541 SGEQKKAIVD LLFKTNRKVT VKQLKEDYFK KIECFDSVEI SGVEDRFNAS LGTYHDLLKI
  601 IKDKDFLDNE ENEDILEDIV LTLTLFEDRE MIEERLKTYA HLFDDKVMKQ LKRRRYTGWG
  661 RLSRKLINGI RDKQSGKTIL DFLKSDGFAN RNFMQLIHDD SLTFKEDIQK AQVSGQGDSL
  721 HEHIANLAGS PAIKKGILQT VKVVDELVKV MGRHKPENIV IEMARENQTT QKGQKNSRER
  781 MKRIEEGIKE LGSQILKEHP VENTQLQNEK LYLYYLQNGR DMYVDQELDI NRLSDYDVDA
  841 IVPQSFLKDD SIDNKVLTRS DKNRGKSDNV PSEEVVKKMK NYWRQLLNAK LITQRKFDNL
  901 TKAERGGLSE LDKAGFIKRQ LVETRQITKH VAQILDSRMN TKYDENDKLI REVKVITLKS
  961 KLVSDFRKDF QFYKVREINN YHHAHDAYLN AVVGTALIKK YPKLESEFVY GDYKVYDVRK
 1021 MIAKSEQEIG KATAKYFFYS NIMNFFKTEI TLANGEIRKR PLIETNGETG EIVWDKGRDF
 1081 ATVRKVLSMP QVNIVKKTEV QTGGFSKESI LPKRNSDKLI ARKKDWDPKK YGGFDSPTVA
 1141 YSVLVVAKVE KGKSKKLKSV KELLGITIME RSSFEKNPID FLEAKGYKEV KKDLIIKLPK
 1201 YSLFELENGR KRMLASAGEL QKGNELALPS KYVNFLYLAS HYEKLKGSPE DNEQKQLFVE
 1261 QHKHYLDEII EQISEFSKRV ILADANLDKV LSAYNKHRDK PIREQAENII HLFTLTNLGA
 1321 PAAFKYFDTT IDRKRYTSTK EVLDATLIHQ SITGLYETRI DLSQLGGD
```

FIG. 15D

```
CjeCas9  (SEQ ID NO:104)
    1 MARILAFDIG ISSIGWAFSE NDELKDCGVR IFTKVENPKT GESLALPRRL ARSARKRLAR
   61 RKARLNHLKH LIANEFKLNY EDYQSFDESL AKAYKGSLIS PYELRFRALN ELLSKQDFAR
  121 VILHIAKRRG YDDIKNSDDK EKGAILKAIK QNEEKLANYQ SVGEYLYKEY FQKFKENSKE
  181 FTNVRNKKES YERCIAQSFL KDELKLIFKK QREFGFSFSK KFEEEVLSVA FYKRALKDFS
  241 HLVGNCSFFT DEKRAPKNSP LAFMFVALTR IINLNNNLKN TEGILYTKDD LNALLNEVLK
  301 NGTLTYKQTK KLLGLSDDYE FKGEKGTYFI EFKKYKEFIK ALGEHNLSQD DLNEIAKDIT
  361 LIKDEIKLKK ALAKYDLNQN QIDSLSKLEF KDHLNISFKA LKLVTPLMLE GKKYDEACNE
  421 LNLKVAINED KKDFLPAFNE TYYKDEVTNP VVLRAIKEYR KVLNALLKKY GKVHKINIEL
  481 AREVGKNHSQ RAKIEKEQNE NYKAKKDAEL ECEKLGLKIN SKNILKLRLF KEQKEFCAYS
  541 GEKIKISDLQ DEKMLEIDHI YPYSRSFDDS YMNKVLVFTK QNQEKLNQTP FEAFGNDSAK
  601 WQKIEVLAKN LPTKKQKRIL DKNYKDKEQK NFKDRNLNDT RYIARLVLNY TKDYLDFLPL
  661 SDDENTKLND TQKGSKVHVE AKSGMLTSAL RHTWGFSAKD RNNHLHHAID AVIIAYANNS
  721 IVKAFSDFKK EQESNSAELY AKKISELDYK NRKFFEPFS GFRQKVLDKI DEIFVSKPER
  781 KKPSGALHEE TFRKEEEFYQ SYGGKEGVLK ALELGKIRKV NGKIVKNGDM FRVDIFKHKK
  841 TNKFYAVPIY TMDFALKVLP NKAVARSKKG EIKDWILMDE NYEFCFSLYK DSLILIQTKD
  901 MQEPEFVYYN AFTSSTVSLI VSKHDNKFET LSKNQKILFK NANEKEVIAK SIGIQNLKVF
  961 EKYIVSALGE VTKAEFRQRE DFKK
```

FIG. 15E

```
FnoCas9 (SEQ ID NO:105)
   1 MNFKILPIAI DLGVKNTGVF SAFYQKGTSL ERLDNKNGKV YELSKDSYTL LMNNRTARRH
  61 QRRGIDRKQL VKRLFKLIWT EQLNLEWDKD TQQAISFLFN RRGFSFITDG YSPEYLNIVP
 121 EQVKAILMDI FDDYNGEDDL DSYLKLATEQ ESKISEIYNK LMQKILEFKL MKLCTDIKDD
 181 KVSTKTLKEI TSYEFELLAD YLANYSESLK TQKFSYTDKQ GNLKELSYYH HDKYNIQEFL
 241 KRHATINDRI LDTLLTDDLD IWNFNFEKFD FDKNEEKLQN QEDKDHIQAH LHHFVFAVNK
 301 IKSEMASGGR HRSQYFQEIT NVLDENNHQE GYLKNFCENL HNKKYSNLSV KNLVNLIGNL
 361 SNLELKPLRK YFNDKIHAKA DHWDEQKFTE TYCHWILGEW RVGVKDQDKK DGAKYSYKDL
 421 CNELKQKVTK AGLVDFLLEL DPCRTIPPYL DNNNRKPPKC QSLILNPKFL DNQYPNWQQY
 481 LQELKKLQSI QNYLDSFETD LKVLKSSKDQ PYFVEYKSSN QQIASGQRDY KDLDARILQF
 541 IFDRVKASDE LLLNEIYFQA KKLKQKASSE LEKLESSKKL DEVIANSQLS QILKSQHTNG
 601 IFEQGTFLHL VCKYYKQRQR ARDSRLYIMP EYRYDKKLHK YNNTGRFDDD NQLLTYCNHK
 661 PRQKRYQLLN DLAGVLQVSP NFLKDKIGSD DDLFISKWLV EHIRGFKKAC EDSLKIQKDN
 721 RGLLNHKINI ARNTKGKCEK EIFNLICKIE GSEDKKGNYK HGLAYELGVL LFGEPNEASK
 781 PEFDRKIKKF NSIYSFAQIQ QIAFAERKGN ANTCAVCSAD NAHRMQQIKI TEPVEDNKDK
 841 IILSAKAQRL PAIPTRIVDG AVKKMATILA KNIVDDNWQN IKQVLSAKHQ LHIPIITESN
 901 AFEFEPALAD VKGKSLKDRR KKALERISPE NIFKDKNNRI KEFAKGISAY SGANLTDGDF
 961 DGAKEELDHI IPRSHKKYGT LNDEANLICV TRGDNKNKGN RIFCLRDLAD NYKLQFETT
1021 DDLEIEKKIA DTIWDANKKD FKFGNYRSFI NLTPQEQKAF RHALFLADEN PIKQAVIRAI
1081 NNRNRTFVNG TQRYFAEVLA NNIYLRAKKE NLNTDKISFD YFGIPTIGNG RGIAEIRQLY
1141 EKVDSDIQAY AKGDKPQASY SHLIDAMLAF CIAADEHRND GSIGLEIDKN YSLYPLDKNT
1201 GEVFTKDIFS QIKITDNEFS DKKLVRKKAI EGFNTHRQMT RDGIYAENYL PILIHKELNE
1261 VRKGYTWKNS EEIKIFKGKK YDIQQLNNLV YCLKFVDKPI SIDIQISTLE ELRNILTTNN
1321 IAATAEYYYI NLKTQKLHEY YIENYNTALG YKKYSKEMEF LRSLAYRSER VKIKSIDDVK
1381 QVLDKDSNFI IGKITLPFKK EWQRLYREWQ NTTIKDDYEF LKSFFNVKSI TKLHKKVRKD
1441 FSLPISTNEG KFLVKRKTWD NNFIYQILND SDSRADGTKP FIPAFDISKN EIVEAIIDSF
1501 TSKNIFWLPK NIELQKVDNK NIFAIDTSKW FEVETPSDLR DIGIATIQYK IDNNSRPKVR
1561 VKLDYVIDDD SKINYFMNHS LLKSRYPDKV LEILKQSTII EFESSGFNKT IKEMLGMKLA
1621 GIYNETSNN
```

FIG. 15F

```
Staphylococcus aureus Cas9 (UniProtKB J7RUA5, SEQ ID NO:110)
   1 MKRNYILGLD IGITSVGYGI IDYETRDVID AGVRLFKEAN VENNEGRRSK RGARRLKRRR
  61 RHRIQRVKKL LFDYNLLTDH SELSGINPYE ARVKGLSQKL SEEEFSAALL HLAKRRGVHN
 121 VNEVEEDTGN ELSTKEQISR NSKALEEKYV AELQLERLKK DGEVRGSINR FKTSDYVKEA
 181 KQLLKVQKAY HQLDQSFIDT YIDLLETRRT YYEGPGEGSP FGWKDIKEWY EMLMGHCTYF
 241 PEELRSVKYA YNADLYNALN DLNNLVITRD ENEKLEYYEK FQIIENVFKQ KKKPTLKQIA
 301 KEILVNEEDI KGYRVTSTGK PEFTNLKVYH DIKDITARKE IIENAELLDQ IAKILTIYQS
 361 SEDIQEELTN LNSELTQEEI EQISNLKGYT GTHNLSLKAI NLILDELWHT NDNQIAIFNR
 421 LKLVPKKVDL SQQKEIPTTL VDDFILSPVV KRSFIQSIKV INAIIKKYGL PNDIIIELAR
 481 EKNSKDAQKM INEMQKRNRQ TNERIEEIIR TTGKENAKYL IEKIKLHDMQ EGKCLYSLEA
 541 IPLEDLLNNP FNYEVDHIIP RSVSFDNSFN NKVLVKQEEN SKKGNRTPFQ YLSSSDSKIS
 601 YETFKKHILN LAKGKGRISK TKKEYLLEER DINRFSVQKD FINRNLVDTR YATRGLMNLL
 661 RSYFRVNNLD VKVKSINGGF TSFLRRKWKF KKERNKGYKH HAEDALIIAN ADFIFKEWKK
 721 LDKAKKVMEN QMFEEKQAES MPEIETEQEY KEIFITPHQI KHIKDFKDYK YSHRVDKKPN
 781 RELINDTLYS TRKDDKGNTL IVNNLNGLYD KDNDKLKKLI NKSPEKLLMY HHDPQTYQKL
 841 KLIMEQYGDE KNPLYKYYEE TGNYLTKYSK KDNGPVIKKI KYYGNKLNAH LDITDDYPNS
 901 RNKVVKLSLK PYRFDVYLDN GVYKFVTVKN LDVIKKENYY EVNSKCYEEA KKLKKISNQA
 961 EFIASFYNND LIKINGELYR VIGVNNDLLN RIEVNMIDIT YREYLENMND KRPPRIIKTI
1021 ASKTQSIKKY STDILGNLYE VKSKKHPQII KKG
```

FIG. 16A

*Campylobacter jejuni subsp. jejuni serotype O:2* Cas9 (UniProtKB Q0P897, SEQ ID NO:111)
```
   1 MARILAFDIG ISSIGWAFSE NDELKDCGVR IFTKVENPKT GESLALPRRL ARSARKRLAR
  61 RKARLNHLKH LIANEFKLNY EDYQSFDESL AKAYKGSLIS PYELRFRALN ELLSKQDFAR
 121 VILHIAKRRG YDDIKNSDDK EKGAILKAIK QNEEKLANYQ SVGEYLYKEY FQKFKENSKE
 181 FTNVRNKKES YERCIAQSFL KDELKLIFKK QREFGFSFSK KFEEEVLSVA FYKRALKDFS
 241 HLVGNCSFFT DEKRAPKNSP LAFMFVALTR IINLLNNLKN TEGILYTKDD LNALLNEVLK
 301 NGTLTYKQTK KLLGLSDDYE FKGEKGTYFI EFKKYKEFIK ALGEHNLSQD DLNEIAKDIT
 361 LIKDEIKLKK ALAKYDLNQN QIDSLSKLEF KDHLNISFKA LKLVTPLMLE GKKYDEACNE
 421 LNLKVAINED KKDFLPAFNE TYYKDEVTNP VVLRAIKEYR KVLNALLKKY GKVHKINIEL
 481 AREVGKNHSQ RAKIEKEQNE NYKAKKDAEL ECEKLGLKIN SKNILKLRLF KEQKEFCAYS
 541 GEKIKISDLQ DEKMLEIDHI YPYSRSFDDS YMNKVLVFTK QNQEKLNQTP FEAFGNDSAK
 601 WQKIEVLAKN LPTKKQKRIL DKNYKDKEQK NFKDRNLNDT RYIARLVLNY TKDYLDFLPL
 661 SDDENTKLND TQKGSKVHVE AKSGMLTSAL RHTWGFSAKD RNNHLHHAID AVIIAYANNS
 721 IVKAFSDFKK EQESNSAELY AKKISELDYK NKRKFFEPFS GFRQKVLDKI DEIFVSKPER
 781 KKPSGALHEE TFRKEEEFYQ SYGGKEGVLK ALELGKIRKV NGKIVKNGDM FRVDIFKHKK
 841 TNKFYAVPIY TMDFALKVLP NKAVARSKKG EIKDWILMDE NYEFCFSLYK DSLILIQTKD
 901 MQEPEFVYYN AFTSSTVSLI VSKHDNKFET LSKNQKILFK NANEKEVIAK SIGIQNLKVF
 961 EKYIVSALGE VTKAEFRQRE DFKK
```
FIG. 16B

*Streptococcus thermophilus* Cas9 (UniProtKB G3ECR1, SEQ ID NO:112)
```
   1 MLFNKCIIIS INLDFSNKEK CMTKPYSIGL DIGTNSVGWA VITDNYKVPS KKMKVLGNTS
  61 KKYIKKNLLG VLLFDSGITA EGRRLKRTAR RRYTRRRNRI LYLQEIFSTE MATLDDAFFQ
 121 RLDDSFLVPD DKRDSKYPIF GNLVEEKVYH DEFPTIYHLR KYLADSTKKA DLRLVYLALA
 181 HMIKYRGHFL IEGEFNSKNN DIQKNFQDFL DTYNAIFESD LSLENSKQLE EIVKDKISKL
 241 EKKDRILKLF PGEKNSGIFS EFLKLIVGNQ ADFRKCFNLD EKASLHFSKE SYDEDLETLL
 301 GYIGDDYSDV FLKAKKLYDA ILLSGFLTVT DNETEAPLSS AMIKRYNEHK EDLALLKEYI
 361 RNISLKTYNE VFKDDTKNGY AGYIDGKTNQ EDFYVYLKNL LAEFEGADYF LEKIDREDFL
 421 RKQRTFDNGS IPYQIHLQEM RAILDKQAKF YPFLAKNKER IEKILTFRIP YYVGPLARGN
 481 SDFAWSIRKR NEKITPWNFE DVIDKESSAE AFINRMTSFD LYLPEEKVLP KHSLLYETFN
 541 VYNELTKVRF IAESMRDYQF LDSKQKKDIV RLYFKDKRKV TDKDIIEYLH AIYGYDGIEL
 601 KGIEQFNSS LSTYHDLLNI INDKEFLDDS SNEAIIEEII HTLTIFEDRE MIKQRLSKFE
 661 NIFDKSVLKK LSRRHYTGWG KLSAKLINGI RDEKSGNTIL DYLIDDGISN RNFMQLIHDD
 721 ALSFKKKIQK AQIIGDEDKG NIKEVVKSLP GSPAIKKGIL QSIKIVDELV KVMGGRKPES
 781 IVVEMARENQ YTNQGKSNSQ QRLKRLEKSL KELGSKILKE NIPAKLSKID NNALQNDRLY
 841 LYYLQNGKDM YTGDDLDIDR LSNYDIDHII PQAFLKDNSI DNKVLVSSAS NRGKSDDFPS
 901 LEVVKKRKTF WYQLLKSKLI SQRKFDNLTK AERGGLLPED KAGFIQRQLV ETRQITKHVA
 961 RLLDEKFNNK KDENNRAVRT VKIITLKSTL VSQFRKDFEL YKVREINDFH HAHDAYLNAV
1021 IASALLKKYP KLEPEFVYGD YPKYNSFRER KSATEKVYFY SNIMNIFKKS ISLADGRVIE
1081 RPLIEVNEET GESVWNKESD LATVRRVLSY PQVNVVKKVE EQNHGLDRGK PKGLFNANLS
1141 SKPKPNSNEN LVGAKEYLDP KKYGGYAGIS NSFAVLVKGT IEKGAKKKIT NVLEFQGISI
1201 LDRINYRKDK LNFLLEKGYK DIELIIELPK YSLFELSDGS RRMLASILST NNKRGEIHKG
1261 NQIFLSQKFV KLLYHAKRIS NTINENHRKY VENHKKEFEE LFYYILEFNE NYVGAKKNGK
1321 LLNSAFQSWQ NHSIDELCSS FIGPTGSERK GLFELTSRGS AADFEFLGVK IPRYRDYTPS
1381 SLLKDATLIH QSVTGLYETR IDLAKLGEG
```
FIG. 16C

```
Streptococcus thermophilus (strain ATCC BAA-491 / LMD-9) Cas9-1 (UniProtKB Q03LF7,
SEQ ID NO:113)
    1 MSDLVLGLDI GIGSVGVGIL NKVTGEIIHK NSRIFPAAQA ENNLVRRTNR QGRRLARRKK
   61 HRRVRLNRLF EESGLITDFT KISINLNPYQ LRVKGLTDEL SNEELFIALK NMVKHRGISY
  121 LDDASDDGNS SVGDYAQIVK ENSKQLETKT PGQIQLERYQ TYGQLRGDFT VEKDGKKHRL
  181 INVFPTSAYR SEALRILQTQ QEFNPQITDE FINRYLEILT GKRKYYHGPG NEKSRTDYGR
  241 YRTSGETLDN IFGILIGKCT FYPDEFRAAK ASYTAQEFNL LNDLNNLTVP TETKKLSKEQ
  301 KNQIINYVKN EKAMGPAKLF KYIAKLLSCD VADIKGYRID KSGKAEIHTF EAYRKMKTLE
  361 TLDIEQMDRE TLDKLAYVLT LNTEREGIQE ALEHEFADGS FSQKQVDELV QFRKANSSIF
  421 GKGWHNFSVK LMMELIPELY ETSEEQMTIL TRLGKQKTTS SSNKTKYIDE KLLTEEIYNP
  481 VVAKSVRQAI KIVNAAIKEY GDFDNIVIEM ARETNEDDEK KAIQKIQKAN KDEKDAAMLK
  541 AANQYNGKAE LPHSVFHGHK QLATKIRLWH QQGERCLYTG KTISIHDLIN NSNQFEVDHI
  601 LPLSITFDDS LANKVLVYAT ANQEKGQRTP YQALDSMDDA WSFRELKAFV RESKTLSNKK
  661 KEYLLTEEDI SKFDVRKKFI ERNLVDTRYA SRVVLNALQE HFRAHKIDTK VSVVRGQFTS
  721 QLRRHWGIEK TRDTYHHHAV DALIIAASSQ LNLWKKQKNT LVSYSEDQLL DIETGELISD
  781 DEYKESVFKA PYQHFVDTLK SKEFEDSILF SYQVDSKFNR KISDATIYAT RQAKVGKDKA
  841 DETYVLGKIK DIYTQDGYDA FMKIYKKDKS KFLMYRHDPQ TFEKVIEPIL ENYPNKQINE
  901 KGKEVPCNPF LKYKEEHGYI RKYSKKGNGP EIKSLYYDS KLGNHIDITP KDSNNKVVLQ
  961 SVSPWRADVY FNKTTGKYEI LGLKYADLQF EKGTGTYKIS QEKYNDIKKK EGVDSDSEFK
 1021 FTLYKNDLLL VKDTETKEQQ LFRFLSRTMP KQKHYVELKP YDKQKFEGGE ALIKVLGNVA
 1081 NSGQCKKGLG KSNISIYKVR TDVLGNQHII KNEGDKPKLD F
```

FIG. 16D

```
Streptococcus thermophilus (strain ATCC BAA-491 / LMD-9) Cas9-2 (UniProtKB Q03JI6,
SEQ ID NO:114)
    1 MTKPYSIGLD IGTNSVGWAV TTDNYKVPSK KMKVLGNTSK KYIKKNLLGV LLFDSGITAE
   61 GRRLKRTARR RYTRRRNRIL YLQEIFSTEM ATLDDAFFQR LDDSFLVPDD KRDSKYPIFG
  121 NLVEEKAYHD EFPTIYHLRK YLADSTKKAD LRLVYLALAH MIKYRGHFLI EGEFNSKNND
  181 IQKNFQDFLD TYNAIFESDL SLENSKQLEE IVKDKISKLE KKDRILKLFP GEKNSGIFSE
  241 FLKLIVGNQA DFRKCFNLDE KASLHFSKES YDEDLETLLG YIGDDYSDVF LKAKKLYDAI
  301 LLSGFLTVTD NETEAPLSSA MIKRYNEHKE DLALLKEYIR NISLKTYNEV FKDDTKNGYA
  361 GYIDGKTNQE DFYVYLKKLL AEFEGADYFL EKIDREDFLR KQRTFDNGSI PYQIHLQEMR
  421 AILDKQAKFY PFLAKNKERI EKILTFRIPY YVGPLARGNS DFAWSIRKRN EKITPWNFED
  481 VIDKESSAEA FINRMTSFDL YLPEEKVLPK HSLLYETFNV YNELTKVRFI AESMRDYQFL
  541 DSKQKKDIVR LYFKDKRKVT DKDIIEYLHA IYGYDGIELK GIEKQFNSSL STYHDLLNII
  601 NDKEFLDDSS NEAIIEEIIH TLTIFEDREM IKQRLSKFEN IFDKSVLKKL SRRHYTGWGK
  661 LSAKLINGIR DEKSGNTILD YLIDDGISNR NFMQLIHDDA LSFKKKIQKA QIIGDEDKGN
  721 IKEVVKSLPG SPAIKKGILQ SIKIVDELVK VMGGRKPESI VVEMARENQY TNQGKSNSQQ
  781 RLKRLEKSLK ELGSKILKEN IPAKLSKIDN NALQNDRLYL YYLQNGKDMY TGDDLDIDRL
  841 SNYDIDHIIP QAFLKDNSID NKVLVSSASN RGKSDDVPSL EVVKKRKTFW YQLLKSKLIS
  901 QRKFDNLTKA ERGGLSPEDK AGFIQRQLVE TRQITKHVAR LLDEKFNNKK DENNRAVRTV
  961 KIITLKSTLV SQFRKDFELY KVREINDFHH AHDAYLNAVV ASALLKKYPK LEPEFVYGDY
 1021 PKYNSFRERK SATEKVYFYS NIMNIFKKSI SLADGRVIER PLIEVNEETG ESVWNKESDL
 1081 ATVRRVLSYP QVNVVKKVEE QNHGLDRGKP KGLFNANLSS KPKPNSNENL VGAKEYLDPK
 1141 KYGGYAGISN SFTVLVKGTI EKGAKKKITN VLEFQGISIL DRINYRKDKL NFLLEKGYKD
 1201 IELIIELPKY SLFELSDGSR RMLASILSTN NKRGEIHKGN QIFLSQKFVK LLYHAKRISN
 1261 TINENHRKYV ENHKKEFEEL FYYILEFNEN YVGAKKNGKL LNSAFQSWQN HSIDELCSSF
 1321 IGPTGSERKG LFELTSRGSA ADFEFLGVKI PRYRDYTPSS LLKDATLIHQ SVTGLYETRI
 1381 DLAKLGEG
```

FIG. 16E

*Wolinella succinogenes* Cas9 (UniProtKB Q7MRD3, SEQ ID NO:115)

```
   1 MIERILGVDL GISSLGWAIV EYDKDDEAAN RIIDCGVRLF TAAETPKKKE SPNKARREAR
  61 GIRRVLNRRR VRMNMIKKLF LRAGLIQDVD LDGEGGMFYS KANRADVWEL RHDGLYRLLK
 121 GDELARVLIH IAKHRGYKFI GDDEADEESG KVKKAGVVLR QNFEAAGCRT VGEWLWRERG
 181 ANGKKRNKHG DYEISIHRDL LVEEVEAIFV AQQEMRSTIA TDALKAAYRE IAFFVRPMQR
 241 IEKMVGHCTY FPEERRAPKS APTAEKFIAI SKFFSTVIID NEGWEQKIIE RKTLEELLDF
 301 AVSREKVEFR HLRKFLDLSD NEIFKGLHYK GKPKTAKKRE ATLFDPNEPT ELEFDKVEAE
 361 KKAWISLRGA AKLREALGNE FYGRFVALGK HADEATKILT YYKDEGQKRR ELTKLPLEAE
 421 MVERLVKIGF SDFLKLSLKA IRDILPAMES GARYDEAVLM LGVPHKEKSA ILPPLNKTDI
 481 DILNPTVIRA FAQFRKVANA LVRKYGAFDR VHFELAREIN TKGEIEDIKE SQRKNEKERK
 541 EAADWIAETS FQVPLTRKNI LKKRLYIQQD GRCAYTGDVI ELERLFDEGY CEIDHILPRS
 601 RSADDSFANK VLCLARANQQ KTDRTPYEWF GHDAARWNAF ETRTSAPSNR VRTGKGKIDR
 661 LLKKNFDENS EMAFKDRNLN DTRYMARAIK TYCEQYWVFK NSHTKAPVQV RSGKLTSVLR
 721 YQWGLESKDR ESHTHHAVDA IIIAFSTQGM VQKLSEYYRF KETHREKERP KLAVPLANFR
 781 DAVEEATRIE NTETVKEGVE VKRLLISRPP RARVTGQAHE QTAKPYPRIK QVKNKKKWRL
 841 APIDEEKFES FKADRVASAN QKNFYETSTI PRVDVYHKKG KFHLVPIYLH EMVLNELPNL
 901 SLGTNPEAMD ENFFKFSIFK DDLISIQTQG TPKKPAKIIM GYFKNMHGAN MVLSSINNSP
 961 CEGFTCTPVS MDKKHKDKCK LCPEENRIAG RCLQGFLDYW SQEGLRPPRK EFECDQGVKF
1021 ALDVKKYQID PLGYYYEVKQ EKRLGTIPQM RSAKKLVKK
```

FIG. 16F

*Wolinella succinogenes* Cas9/Csx12 (NCBI WP_011139431.1, SEQ ID NO:116)

```
   1 MLVSPISVDL GGKNTGFFSF TDSLDNSQSG TVIYDESFVL SQVGRRSKRH SKRNNLRNKL
  61 VKRLFLLILQ EHHGLSIDVL PDEIRGLFNK RGYTYAGFEL DEKKKDALES DTLKEFLSEK
 121 LQSIDRDSDV EDFLNQIASN AESFKDYKKG FEAVFASATH SPNKKLELKD ELKSEYGENA
 181 KELLAGLRVT KEILDEFDKQ ENQGNLPRAK YFEELGEYIA TNEKVKSFFD SNSLKLTDMT
 241 KLIGNISNYQ LKELRRYFND KEMEKGDIWI PNKLHKITER FVRSWHPKND ADRQRRAELM
 301 KDLKSKEIME LLTTTEPVMT IPPYDDMNNR GAVKCQTLRL NEEYLDKHLP NWRDIAKRLN
 361 HGKFNDDLAD STVKGYSEDS TLLHRLLDTS KEIDIYELRG KKPNELLVKT LGQSDANRLY
 421 GFAQNYYELI RQKVRAGIWV PVKNKDDSLN LEDNSNMLKR CNHNPPHKKN QIHNLVAGIL
 481 GVKLDEAKFA EFEKELWSAK VGNKKLSAYC KNIEELRKTH GNTFKIDIEE LRKKDPAELS
 541 KEEKAKLRLT DDVILNEWSQ KIANFFDIDD KHRQRFNNLF SMAQLHTVID TPRSGFSSTC
 601 KRCTAENRFR SETAFYNDET GEFHKKATAT CQRLPADTQR PFSGKIERYI DKLGYELAKI
 661 KAKELEGMEA KEIKVPIILE QNAFEYEESL RKSKTGSNDR VINSKKDRDG KKLAKAKENA
 721 EDRLKDKDKR IKAFSSGICP YCGDTIGDDG EIDHILPRSH TLKIYGTVFN PEGNLIYVHQ
 781 KCNQAKADSI YKLSDIKAGV SAQWIEEQVA NIKGYKTFSV LSAEQQKAFR YALFLQNDNE
 841 AYKKVVDWLR TDQSARVNGT QKYLAKKIQE KLTKMLPNKH LSFEFILADA TEVSELRRQY
 901 ARQNPLLAKA EKQAPSSHAI DAVMAFVARY QKVFKDGTPP NADEVAKLAM LDSWNPASNE
 961 PLTKGLSTNQ KIEKMIKSGD YGQKNMREVF GKSIFGENAI GERYKPIVVQ EGGYYIGYPA
1021 TVKKGYELKN CKVVTSKNDI AKLEKIIKNQ DLISLKENQY IKIFSINKQT ISELSNRYFN
1081 MNYKNLVERD KEIVGLLEFI VENCRYYTKK VDVKFAPKYI HETKYPFYDD WRRFDEAWRY
1141 LQENQNKTSS KDRFVIDKSS LNEYYQPDKN EYKLDVDTQP IWDDFCRWYF LDRYKTANDK
1201 KSIRIKARKT FSLLAESGVQ GKVFRAKRKI PTGYAYQALP MDNNVIAGDY ANILLEANSK
1261 TLSLVPKSGI SIEKQLDKKL DVIKKTDVRG LAIDNNSFFN ADFDTHGIRL IVENTSVKVG
1321 NFPISAIDKS AKRMIFRALF EKEKGKRKKK TTISFKESGP VQDYLKVFLK KIVKIQLRTD
1381 GSISNIVVRK NAADFTLSFR SEHIQKLLK
```

FIG. 16G

*Staphylococcus lugdunensis* Cas9(UniProtKB A0A133QCR3, SEQ ID NO:117)

```
   1 MNQKFILGLD IGITSVGYGL IDYETKNIID AGVRLFPEAN VENNEGRRSK RGSRRLKRRR
  61 IHRLERVKKL LEDYNLLDQS QIPQSTNPYA IRVKGLSEAL SKDELVIALL HIAKRRGIHK
 121 IDVIDSNDDV GNELSTKEQL NKNSKLLKDK FVCQIQLERM NEGQVRGEKN RFKTADIIKE
 181 IIQLLNVQKN FHQLDENFIN KYIELVEMRR EYFEGPGKGS PYGWEGDPKA WYETLMGHCT
 241 YFPDELRSVK YAYSADLFNA LNDLNNLVIQ RDGLSKLEYH EKYHIIENVF KQKKKPTLKQ
 301 IANEINVNPE DIKGYRITKS GKPQFTEFKL YHDLKSVLFD QSILENEDVL DQIAEILTIY
 361 QDKDSIKSKL TELDILLNEE DKENIAQLTG YTGTHRLSLK CIRLVLEEQW YSSRNQMEIF
 421 THLNIKPKKI NLTAANKIPK AMIDEFILSP VVKRTFGQAI NLINKIIEKY GVPEDIIIEL
 481 ARENNSKDKQ KFINEMQKKN ENTRKRINEI IGKYGNQNAK RLVEKIRLHD EQEGKCLYSL
 541 ESIPLEDLLN NPNHYEVDHI IPRSVSFDNS YHNKVLVKQS ENSKKSNLTP YQYFNSGKSK
 601 LSYNQFKQHI LNLSKSQDRI SKKKEYLLE ERDINKFEVQ KEFINRNLVD TRYATRELTN
 661 YLKAYFSANN MNVKVKTING SFTDYLRKVW KFKKERNHGY KHHAEDALII ANADFLFKEN
 721 KKLKAVNSVL EKPEIESKQL DIQVDSEDNY SEMFIIPKQV QDIKDFRNFK YSHRVDKKPN
 781 RQLINDTLYS TRKKDNSTYI VQTIKDIYAK DNTTLKKQFD KSPEKFLMYQ HDPRTFEKLE
 841 VIMKQYANEK NPLAKYHEET GEYLTKYSKK NNGPIVKSLK YIGNKLGSHL DVTHQFKSST
 901 KKLVKLSIKP YRFDVYLTDK GYKFITISYL DVLKKDNYYY IPEQKYDKLK LGKAIDKNAK
 961 FIASFYKNDL IKLDGEIYKI IGVNSDTRNM IELDLPDIRY KEYCELNNIK GEPRIKKTIG
1021 KKVNSIEKLT TDVLGNVFTN TQYTKPQLLF KRGN
```

FIG. 16H

*Staphylococcus pseudintermedius* ED99 Cas9 (GenBank ADX75954.1, SEQ ID NO:118)

```
   1 MGRKPYILSL DIGTGSVGYA CMDKGFNVLK YHDKDALGVY LFDGALTAQE RRQFRTSRRR
  61 KNRRIKRLGL LQELLAPLVQ NPNFYQFRQ FAWKNDNMDF KNKSLSEVLS FLGYESKKYP
 121 TIYHLQEALL LKDEKFDPEL IYMALYHLVK YRGHFLFDHL KIENLTNNDN MHDFVELIET
 181 YENLNNIKLN LDYEKTKVIY EILKDNEMTK NDRAKRVKNM EKKLEQFSIM LLGLKFNEGK
 241 LFNHADNAEE LKGANQSHTF ADNYEENLTP FLTVEQSEFI ERANKIYLSL TLQDILKGKK
 301 SMAMSKVAAY DKFRNELKQV KDIVYKADST RTQFKKIFVS SKKSLKQYDA TPNDQTFSSL
 361 CLFDQYLIRP KKQYSLLIKE LKKIIPQDSE LYFEAENDTL LKVLNTTDNA SIPMQINLYE
 421 AETILRNQQK YHAEITDEMI EKVLSLIQFR IPYYVGPLVN DHTASKFGWM ERKSNESIKP
 481 WNFDEVVDRS KSATQFIRRM TNKCSYLINE DVLPKNSLLY QEMEVLNELN ATQIRLQTDP
 541 KNRKYRMMPQ IKLFAVEHIF KKYKTVSHSK FLEIMLNSNH RENFMNHGEK LSIFGTQDDK
 601 KFASKLSSYQ DMTKIFGDIE GKRAQIEEII QWITIFEDKK ILVQKLKECY PELTSKQINQ
 661 LKKLNYSGWG RLSEKLLTHA YQGHSIIELL RHSDENFMEI LTNDVYGFQN FIKEENQVQS
 721 NKIQHQDIAN LTTSPALKKG IWSTIKLVRE LTSIFGEPEK IIMEFATEDQ QKGKKQKSRK
 781 QLWDDNIKKN KLKSVDEYKY IIDVANKLNN EQLQQEKLWL YLSQNGKCMY SGQSIDLDAL
 841 LSPNATKHYE VDHIFPRSFI KDDSIDNKVL VIKKMNQTKG DQVPLQFIQQ PYERIAYWKS
 901 LNKAGLISDS KLHKLMKPEF TAMDKEGFIQ RQLVETRQIS VHVRDFLKEE YPNTKVIPMK
 961 AKMVSEFRKK FDIPKIRQMN DAHHAIDAYL NGVVYHGAQL AYPNVDLFDF NFKWEKVREK
1021 WKALGEFNTK QKSRELFFFK KLEKMEVSQG ERLISKIKLD MNHFKINYSR KLANIPQQFY
1081 NQTAVSPKTA ELKYESNKSN EVVYKGLTPY QTYVVAIKSV NKKGKEKMEY QMIDHYVFDF
1141 YKFQNGNEKE LALYLAQREN KDEVLDAQIV YSLNKGDLLY INNHPCYFVS RKEVINAKQF
1201 ELTVEQQLSL YNVMNNKETN VEKLLIEYDF IAEKVINEYH HYLNSKLKEK RVRTFFSESN
1261 QTHEDFIKAL DELFKVVTAS ATRSDKIGSR KNSMTHRAFL GKGKDVKIAY TSISGLKTTK
1321 PKSLFKLAES RNEL
```

FIG. 16I

*Helicobacter mustelae* Cas9 (UniProtKB D3UFL8, SEQ ID NO:119)

```
   1 MIRTLGIDIG IASIGWAVIE GEYTDKGLEN KEIVASGVRV FTKAENPKNK ESLALPRTLA
  61 RSARRRNARK KGRIQQVKHY LSKALGLDLE CFVQGEKLAT LFQTSKDFLS PWELRERALY
 121 RVLDKEELAR VILHIAKRRG YDDITYGVED NDSGKIKKAI AENSKRIKEE QCKTIGEMMY
 181 KLYFQKSLNV RNKKESYNRC VGRSELREEL KTIFQIQQEL KSPWVNEELI YKLLGNPDAQ
 241 SKQEREGLIF YQRPLKGFGD KIGKCSHIKK GENSPYRACK HAPSAEEFVA LTKSINFLKN
 301 LTNRHGLCFS QEDMCVYLGK ILQEAQKNEK GLTYSKLKLL LDLPSDFEFL GLDYSGKNPE
 361 KAVFLSLPST FKLNKITQDR KTQDKIANIL GANKDWEAIL KELESLQLSK EQIQTIKDAK
 421 LNFSKHINLS LEALYHLLPL MREGKRYDEG VEILQERGIF SKPQPKNRQL LPPLSELAKE
 481 ESYFDIPNPV LRRALSEFRK VVNALLEKYG GFHYFHIELT RDVCKAKSAR MQLEKINKKN
 541 KSENDAASQL LEVLGLPNTY NNRLKCKLWK QQEEYCLYSG EKITIDHLKD QRALQIDHAF
 601 PLSRSLDDSQ SNKVLCLTSS NQEKSNKTPY EWLGSDEKKW DMYVGRVYSS NFSPSKKRKL
 661 TQKNFKERNE EDFLARNLVD TGYIGRVTKE YIKHSLSFLP LPDGKKEHIR IISGSMTSTM
 721 RSFWGVQEKN RDHHLHHAQD AIIIACIEPS MIQKYTTYLK DKETHRLKSH QKAQILREGD
 781 HKLSLRWPMS NFKDKIQESI QNIIPSHHVS HKVTGELHQE TVRTKEFYYQ AFGGEEGVKK
 841 ALKFGKIREI NQGIVDNGAM VRVDIFKSKD KGKFYAVPIY TYDFAIGKLP NKAIVQGKKN
 901 GIIKDWLEMD ENYEFCFSLF KNDCIKIQTK EMQEAVLAIY KSTNSAKATI ELEHLSKYAL
 961 KNEDEEKMFT DTDKEKNKTM TRESCGIQGL KVFQKVKLSV LGEVLEHKPR NRQNIALKTT
1021 PKHV
```

FIG. 16J

*Streptococcus pasteurianus* Cas9 (UniProtKB A0A135YMA6, SEQ ID NO:120)

```
   1 MTKKNYSIGL DIGTNSVGWA VITDDYKVPA KKMKVLGNTD KKYIKKNLLG ALLFDSGETA
  61 EATRLKRTAR RRYTRRKNRL RYLQEIFAEE MTKVDESFFY RLDESFLTTD EKDFERHPIF
 121 GNKADEIKYH QEFPTIYHLR KHLADSSEKA DLRLVYLALA HMIKFRGHFL IEGELNAENT
 181 DVQKIFADFV GVYDRTFDDS HLSEITVDAA SILTEKISKS RRLENLIKYY PTEKKNTLFG
 241 NLIALALGLQ PNFKMNFKLS EDAKLQFSKD SYNEDLEELL GKIGDDYADL FTSAKNLYDA
 301 ILLSGILTVD DNSTKAPLSA SMIKRYAEHH EDLEKLKEFI KANKSELYHD IFKDETKNGY
 361 AGYIENGVKQ DEFYKYLKNT LSKIAGSDYF LDKIEREDFL RKQRTFDNGS IPHQIHLQEM
 421 HAILRRQGDY YPFLKENQDR IEKILTFRIP YYVGPLARKD SRFSWAEYHS DEKITPWNFD
 481 KVIDKEKSAE KFITRMTLND LYLPEEKVLP KHSHVYETYA VYNELTKIKY VNEQGKDSFF
 541 DSNMKQEIFD HVFKENRKVT KEKLLNYLNK EFPEYRIKDL IGLDKENKSF NASLGTYHDL
 601 KKILDKAFLD DKVNEEVIED IIKTLTLFED KDMIHERLQK YSDIFTADQL KKLERRHYTG
 661 WGRLSYKLIN GIRNKENNKT ILDYLIDDGS ANRNFMQLIN DDTLPFKQII QKSQVVGDVD
 721 DIEAVVHDLP GSPAIKKGIL QSVKIVDELV KVMGDNPDNI VIEMARENQT TNRGRSQSQQ
 781 RLKKLQNSLK ELGSNILNEE KPSYIEDKVE NSHLQNDQLF LYYIQNGKDM YTGDELDIDH
 841 LSDYDIDHII PQAFIKDDSI DNRVLTSSAK NRGKSDDVPS LDIVRARKAE WVRLYKSGLI
 901 SKRKFDNLTK AERGGLTEAD KAGFIKRQLV ETRQITKHVA QILDARFNTE SDENDKVIRD
 961 VKVITLKSNL VSQFRKDFEF YKVREINDYH HAHDAYLNAV VGTALLKKYP KLASEFVYGE
1021 YKKYDVHKLI AKSSDDHSEM GKATAKYFFY SNLMNFFKRV IRYSNGKVIV RPVVEYSKDT
1081 EDIAWDKKSN FRTICKVLSY PQVNIVKKVE TQTGGFSKES ILPKGDSDKL IPRKTKKAYW
1141 DTKKYGGFDS PTVAYSVFVV ADVEKGKAKK LKTVKELVGI SIMERSFFEE NPVEFLENKG
1201 YHNIREDKLI KLPKYSLFEF EGGKRRLLAS ASELQKGNEM VIPGHLVKLL YHAQRINSFN
1261 STKYLDYVSA HKKEFEKVLS CVEDFANLYV DVEKNLSKIR AVADSMDNFS IEEISNSFIN
1321 LLTLTALGAP ADFNFLGEKI PRKRYTSTKE CLNATLIHQS ITGLYETRID LSKIGEE
```

FIG. 16K

*Streptococcus pasteurianus* (strain ATCC 43144 / JCM 5346 / CDC 1723-81) Cas9
(UniProtKB F5X275, SEQ ID NO:121)
```
   1 MTNGKILGLD IGIASVGVGI IEAKTGKVVH ANSRLFSAAN AENNAERRGF RGSRRLNRRK
  61 KHRVKRVRDL FEKYGIVTDF RNLNLNPYEL RVKGLTEQLK NEELFAALRT ISKRRGISYL
 121 DDAEDDSTGS TDYAKSIDEN RRLLKNKTPG QIQLERLEKY GQLRGNFTVY DENGEAHRLI
 181 NVFSTSDYEK EARKILETQA DYNKKITAEF IDDYVEILTQ KRKYYHGPGN EKSRTDYGRF
 241 RTDGTTLENI FGILIGKCNF YPDEYRASKA SYTAQEYNFL NDLNNLKVST ETGKLSTEQK
 301 ESLVEFAKNT ATLGPAKLLK EIAKILDCKV DEIKGYREDD KGKPDLHTFE PYRKLKFNLE
 361 SINIDDLSRE VIDKLADILT LNTEREGIED AIKRNLPNQF TEEQISEIIK VRKSQSTAFN
 421 KGWHSFSAKL MNELIPELYA TSDEQMTILT RLEKFKVNKK SSKNTKTIDE KEVTDEIYNP
 481 VVAKSVRQTI KIINAAVKKY GDFDKIVIEM PRDKNADDEK KFIDKRNKEN KKEKDDALKR
 541 AAYLYNSSDK LPDEVFHGNK QLETKIRLWY QQGERCLYSG KPISIQELVH NSNNFEIDHI
 601 LPLSLSFDDS LANKVLVYAW TNQEKGQKTP YQVIDSMDAA WSFREMKDYV LKQKGLGKKK
 661 RDYLLTTENI DKIEVKKKFI ERNLVDTRYA SRVVLNSLQS ALRELGKDTK VSVVRGQFTS
 721 QLRRKWKIDK SRETYHHHAV DALIIAASSQ LKLWEKQDNP MFVDYGKNQV VDKQTGEILS
 781 VSDDEYKELV FQPPYQGFVN TISSKGFEDE ILFSYQVDSK YNRKVSDATI YSTRKAKIGK
 841 DKKEETYVLG KIKDIYSQNG FDTFIKKYNK DKTQFLMYQK DSLTWENVIE VILRDYPTTK
 901 KSEDGKNDVK CNPFEEYRRE NGLICKYSKK GKGTPIKSLK YYDKKLGNCI DITPEESRNK
 961 VILQSINPWR ADVYFNPETL KYELMGLKYS DLSFEKGTGN YHISQEKYDA IKEKEGIGKK
1021 SEFKFTLYRN DLILIKDIAS GEQEIYRFLS RTMPNVNHYV ELKPYDKEKF DNVQELVEAL
1081 GEADKVGRCI KGLNKPNISI YKVRTDVLGN KYFVKKKGDK PKLDFKNNKK
```

FIG. 16L

*Listeria innocua* Clip11262 Cas9 (UniProtKB Q927P4.1, SEQ ID NO:122)
```
   1 MKKPYTIGLD IGTNSVGWAV LTDQYDLVKR KMKIAGDSEK KQIKKNFWGV RLFDEGQTAA
  61 DRRMARTARR RIERRRNRIS YLQGIFAEEM SKTDANFFCR LSDSFYVDNE KRNSHPFFA
 121 TIEEEVEYHK NYPTIYHLRE ELVNSSEKAD LRLVYLALAH IIKYRGNFLI EGALDTQNTS
 181 VDGIYKQFIQ TYNQVFASGI EDGSLKKLED NKDVAKILVE KVTRKEKLER ILKLYPGEKS
 241 AGMFAQFISL IVGSKGNFQK PFDLIEKSDI ECAKDSYEED LESLLALIGD EYAELFVAAK
 301 NAYSAVVLSS IITVAETETN AKLSASMIER FDTHEEDLGE LKAFIKLHLP KHYEEIFSNT
 361 EKHGYAGYID GKTKQADFYK YMKMTLENIE GADYFIAKIE KENFLRKQRT FDNGAIPHQL
 421 HLEELEAILH QQAKYYPFLK ENYDKIKSLV TFRIPYFVGP LANGQSEFAW LTRKADGEIR
 481 PWNIEEKVDF GKSAVDFIEK MTNKDTYLPK ENVLPKHSLC YQKYLVYNEL TKVRYINDQG
 541 KTSYFSGQEK EQIFNDLFKQ KRKVKKKDLE LFLRNMSHVE SPTIEGLEDS FNSSYSTYHD
 601 LLKVGIKQEI LDNPVNTEML ENIVKILTVF EDKRMIKEQL QQFSDVLDGV VLKKLERRHY
 661 TGWGRLSAKL LMGIRDKQSH LTILDYLMND DGLNRNLMQL INDSNLSFKS IIEKEQVTTA
 721 DKDIQSIVAD LAGSPAIKKG ILQSLKIVDE LVSVMGYPPQ TIVVEMAREN QTTGKGKNNS
 781 RPRYKSLEKA IKEFGSQILK EHPTDNQELR NNRLYLYYLQ NGKDMYTGQD LDIHNLSNYD
 841 IDHIVPQSFI TDNSIDNLVL TSSAGNREKG DDVPPLEIVR KRKVFWEKLY QGNLMSKRKF
 901 DYLTKAERGG LTEADKARFI HRQLVETRQI TKNVANILHQ RFNYEKDDHG NTMKQVRIVT
 961 LKSALVSQFR KQFQLYKVRD VNDYHHAHDA YLNGVVANTL LKVYPQLEPE FVYGDYHQFD
1021 WFKANKATAK KQFYTNIMLF FAQKDRIIDE NGEILWDKKY LDTVKKVMSY RQMNIVKKTE
1081 IQKGEFSKAT IKPKGNSSKL IPRKTNWDPM KYGGLDSPNM AYAVVIEYAK GKNKLVFEKK
1141 IIRVTIMERK AFEKDEKAFL EEQGYRQPKV LAKLPKYTLY ECEEGRRRML ASANEAQKGN
1201 QQVLPNHLVT LLHHAANCEV SDGKSLDYIE SNREMFAELL AHVSEFAKRY TLAEANLNKI
1261 NQLFEQNKEG DIKAIAQSFV DLMAFNAMGA PASFKFFETT IERKRYNNLK ELLNSTIIYQ
1321 SITGLYESRK RLDD
```

FIG. 16M

*Neisseria meningitidis*, serogroup C (strain 8013) Cas9 (SEQ ID NO:123)

```
   1 MAAFKPNSIN YILGLDIGIA SVGWAMVEID EEENPIRLID LGVRVFERAE VPKTGDSLAM
  61 ARRLARSVRR LTRRRAHRLL RTRRLLKREG VLQAANFDEN GLIKSLPNTP WQLRAAALDR
 121 KLTPLEWSAV LLHLIKHRGY LSQRKNEGET ADKELGALLK GVAGNAHALQ TGDFRTPAEL
 181 ALNKFEKESG HIRNQRSDYS HTFSRKDLQA ELILLFEKQK EFGNPHVSGG LKEGIETLLM
 241 TQRPALSGDA VQKMLGHCTF EPAEPKAAKN TYTAERFIWL TKLNNLRILE QGSERPLTDT
 301 ERATLMDEPY RKSKLTYAQA RKLLGLEDTA FFKGLRYGKD NAEASTLMEM KAYHAISRAL
 361 EKEGLKDKKS PLNLSPELQD EIGTAFSLFK TDEDITGRLK DRIQPEILEA LLKHISFDKF
 421 VQISLKALRR IVPLMEQGKR YDEACAEIYG DHYGKKNTEE KIYLPPIPAD EIRNPVVLRA
 481 LSQARKVING VVRRYGSPAR IHIETAREVG KSFKDRKEIE KRQEENRKDR EKAAAKFREY
 541 FPNFVGEPKS KDILKLRLYE QQHGKCLYSG KEINLGRLNE KGYVEIDHAL PFSRTWDDSF
 601 NNKVLVLGSE NQNKGNQTPY EYFNGKDNSR EWQEFKARVE TSRFPRSKKQ RILLQKFDED
 661 GFKERNLNDT RYVNRFLCQF VADRMRLTGK GKKRVFASNG QITNLLRGFW GLRKVRAEND
 721 RHHALDAVVV ACSTVAMQQK ITRFVRYKEM NAFDGKTIDK ETGEVLHQKT HFPQPWEFFA
 781 QEVMIRVFGK PDGKPEFEEA DTLEKLRTLL AEKLSSRPEA VHEYVTPLFV SRAPNRKMSG
 841 QGHMETVKSA KRLDEGVSVL RVPLTQLKLK DLEKMVNRER EPKLYEALKA RLEAHKDDPA
 901 KAFAEPFYKY DKAGNRTQQV KAVRVEQVQK TGVWVRNHNG IADNATMVRV DVFEKGDKYY
 961 LVPIYSWQVA KGILPDRAVV QGKDEEDWQL IDDSFNFKFS LHPNDLVEVI TKKARMFGYF
1021 ASCHRGTGNI NIRIHDLDHK IGKNGILEGI GVKTALSFQK YQIDELGKEI RPCRLKKRPP
1081 VR
```

FIG. 16N

*Neisseria meningitidis*, serogroup A / serotype 4A (strain Z2491) Cas9 (SEQ ID NO:124)

```
   1 MAAFKPNPIN YILGLDIGIA SVGWAMVEID EDENPICLID LGVRVFERAE VPKTGDSLAM
  61 ARRLARSVRR LTRRRAHRLL RARRLLKREG VLQAADFDEN GLIKSLPNTP WQLRAAALDR
 121 KLTPLEWSAV LLHLIKHRGY LSQRKNEGET ADKELGALLK GVADNAHALQ TGDFRTPAEL
 181 ALNKFEKESG HIRNQRGDYS HTFSRKDLQA ELILLFEKQK EFGNPHVSGG LKEGIETLLM
 241 TQRPALSGDA VQKMLGHCTF EPAEPKAAKN TYTAERFIWL TKLNNLRILE QGSERPLTDT
 301 ERATLMDEPY RKSKLTYAQA RKLLGLEDTA FFKGLRYGKD NAEASTLMEM KAYHAISRAL
 361 EKEGLKDKKS PLNLSPELQD EIGTAFSLFK TDEDITGRLK DRIQPEILEA LLKHISFDKF
 421 VQISLKALRR IVPLMEQGKR YDEACAEIYG DHYGKKNTEE KIYLPPIPAD EIRNPVVLRA
 481 LSQARKVING VVRRYGSPAR IHIETAREVG KSFKDRKEIE KRQEENRKDR EKAAAKFREY
 541 FPNFVGEPKS KDILKLRLYE QQHGKCLYSG KEINLGRLNE KGYVEIDHAL PFSRTWDDSF
 601 NNKVLVLGSE NQNKGNQTPY EYFNGKDNSR EWQEFKARVE TSRFPRSKKQ RILLQKFDED
 661 GFKERNLNDT RYVNRFLCQF VADRMRLTGK GKKRVFASNG QITNLLRGFW GLRKVRAEND
 721 RHHALDAVVV ACSTVAMQQK ITRFVRYKEM NAFDGKTIDK ETGEVLHQKT HFPQPWEFFA
 781 QEVMIRVFGK PDGKPEFEEA DTPEKLRTLL AEKLSSRPEA VHEYVTPLFV SRAPNRKMSG
 841 QGHMETVKSA KRLDEGVSVL RVPLTQLKLK DLEKMVNRER EPKLYEALKA RLEAHKDDPA
 901 KAFAEPFYKY DKAGNRTQQV KAVRVEQVQK TGVWVRNHNG IADNATMVRV DVFEKGDKYY
 961 LVPIYSWQVA KGILPDRAVV QGKDEEDWQL IDDSFNFKFS LHPNDLVEVI TKKARMFGYF
1021 ASCHRGTGNI NIRIHDLDHK IGKNGILEGI GVKTALSFQK YQIDELGKEI RPCRLKKRPP
1081 VR
```

FIG. 16O

*Geobacillus stearothermophilus* Cas9 (SEQ ID NO:125)

```
   1 MRYKIGLDIG ITSVGWAVMN LDIPRIEDLG VRIFDRAENP QTGESLALPR RLARSARRRL
  61 RRRKHRLERI RRLVIREGIL TKEELDKLFE EKHEIDVWQL RVEALDRKLN NDELARVLLH
 121 LAKRRGFKSN RKSERSNKEN STMLKHIEEN RAILSSYRTV GEMIVKDPKF ALHKRNKGEN
 181 YTNTIARDDL EREIRLIFSK QREFGNMSCT EEFENEYITI WASQRPVASK DDIEKKVGFC
 241 TFEPKEKRAP KATYTFQSFI AWEHINKLRL ISPSGARGLT DEERRLLYEQ AFQKNKITYH
 301 DIRTLLHLPD DTYFKGIVYD RGESRKQNEN IRFLELDAYH QIRKAVDKVY GKGKSSSFLP
 361 IDFDTFGYAL TLFKDDADIH SYLRNEYEQN GKRMPNLANK VYDNELIEEL LNLSFTKFGH
 421 LSLKALRSIL PYMEQGEVYS SACERAGYTF TGPKKKQKTM LLPNIPPIAN PVVMRALTQA
 481 RKVVNAIIKK YGSPVSIHIE LARDLSQTFD ERRKTKKEQD ENRKKNETAI RQLMEYGLTL
 541 NPTGHDIVKF KLWSEQNGRC AYSLQPIEIE RLLEPGYVEV DHVIPYSRSL DDSYTNKVLV
 601 LTRENREKGN RIPAEYLGVG TERWQQFETF VLTNKQFSKK KRDRLLRLHY DENEETEFKN
 661 RNLNDTRYIS RFFANFIREH LKFAESDDKQ KVYTVNGRVT AHLRSRWEFN KNREESDLHH
 721 AVDAVIVACT TPSDIAKVTA FYQRREQNKE LAKKTEPHFP QPWPHFADEL RARLSKHPKE
 781 SIKALNLGNY DDQKLESLQP VFVSRMPKRS VTGAAHQETL RRYVGIDERS GKIQTVVKTK
 841 LSEIKLDASG HFPMYGKESD PRTYEAIRQR LLEHNNDPKK AFQEPLYKPK KNGEPGPVIR
 901 TVKIIDTKNQ VIPLNDGKTV AYNSNIVRVD VFEKDGKYYC VPVYTMDIMK GILPNKAIEP
 961 NKPYSEWKEM TEDYTFRFSL YPNDLIRIEL PREKTVKTAA GEEINVKDVF VYYKTIDSAN
1021 GGLELISHDH RFSLRGVGSR TLKRFEKYQV DVLGNIYKVR GEKRVGLASS AHSKPGKTIR
1081 PLQSTRD
```

FIG. 16P

*Geobacillus sp. LC300* Cas 9 (SEQ ID NO:126)

```
   1 MRYKIGLDIG ITSVGWAVIN LDIPRIEDLG VRIFDRAENP QTGESLALPR RLARSARRRL
  61 RRRKHRLERI RRLIIREGIL TKEELDKLFE EKHEIDVWQL RVEALDRKLN NDELARVLLH
 121 LAKRRGFKSN RKSERSNKEN STMLKHIEEN RAILSSYRTV GEMIVKDPKF ALHKRNKGEN
 181 YTNTIARDDL EREIRLIFSK QREFGNMSCT EEFENEYIAI WASQRPVASK DDIEKKVGFC
 241 TFEPKEKRAP KATYTFQSFI AWEHINKLRL ISPSGTRGLT DEERRLLYEQ AFQKNKITYH
 301 DIRTLLHLPD DTYFKGIVYD RGESRKQNEN IRFLELDAYH QIRKAVDKVY GKGKSSSFLP
 361 IDFDTFGYAL TLFKDDADIR SYLRNEYEQN GKRMPNLANK VYDNELIEEL LNLSFTKFGH
 421 LSLKALRSIL PYMEQGEVYS SACERAGYTF TGPKKKQKTM LLPNIPPIAN PVVMRALTQA
 481 RKVVNAIIKK YGSPVSIHIE LARDLSQTFD ERRKTKKEQD ENRKKNETAI RQLMEYGLTL
 541 NPTGHDIVKF KLWSEQNGRC AYSLQPIEIE RLLEPGYTEV DHVIPYSRSL DDSYTNKVLV
 601 LTKENREKGN RIPAEYLGVG TERWQQFETF VLTNKQFSKK KRDRLLRLHY DENEETEFKN
 661 RNLNDTRYIS RFFANFIREH LKFAESDDKQ KVYTVNGRVT AHLRSRWEFN KNREESDLHH
 721 AVDAVIVACT TPSDIAKVTA FYQRREQNKE LAKKTEPHFP QPWPHFADEL RARLSKHPKE
 781 SIKALNLGNY DDQKLESLQP VFVSRMPKRS VTGAAHQETL RRYVGIDERS GKIQTVVKTK
 841 LSEIKLDASG HFPMYGKESD PRTYEAIRQR LLEHNNDPKK AFQEPLYKPK KNGEPGPVIR
 901 TVKIIDTKNQ VIPLNDGKTV AYNSNIVRVD VFEKDGKYYC VPVYTMDIMK GILPNKAIEP
 961 NKPYSEWKEM TEDYTFRFSL YPNDLIRIEL PREKIIKTAG GEEIKIKDLF AYYKTIHSGT
1021 AGLELVSHDC SFSLSGVGSR TLKRFEKYQV DVLGNIYKVR GEKRVGLASS AHSKTGETIR
1081 PLQSTRD
```

FIG. 16Q

(SEQ ID NO:12)

| Portion | Sequence (e.g., for use with SpyCas9) | SEQ ID NO: |
|---|---|---|
| E | GUUUUAGAGCUAUGCUGUUUUGAAUGGUCCCAAAAC | 150 |
| | GTTTTAGAGCTATGCTGTTTTGAATGGTCCCAAAAC | 151 |
| | GUUUUAGAGCUAUGCUGUUUUG | 152 |
| | GTTTTAGAGCTATGCTGTTTTG | 153 |
| | GUUUUAGAGCUAUGCU | 154 |
| | GTTTTAGAGCTATGCT | 155 |
| | GUUUUAGAGCUAG | 156 |
| | GTTTTAGAGCTAG | 157 |
| | GUUUUAGAGCUA | 158 |
| | GTTTTAGAGCTA | 159 |
| L | GGAAAC | 160 |
| | GGAAA | 161 |
| | GAAA | 162 |
| | TGAA | 163 |
| | UGAA | 164 |
| | AAA | 165 |
| F | ATAGCAAGTTAAAATAAGGCTAGTCCGTTATCAACTTGAAAAAGTGGCACCGAGTCGGTGCTTTTTT | 166 |
| | TAGCAAGTTAAAATAAGGCTAGTCCGTTATCAACTTGAAAAAGTGGCACCGAGTCGGTGCTTTTTT | 167 |
| | TAGCAAGTTAAAATAAGGCTAGTCCGTTATCAACTTGAAAAAGTGGCACCGAGTCGGTGC | 168 |
| | UUGUUGGAACCAUUCAAAACAGCAUAGCAAGUUAAA | 169 |
| | TTGTTGGAACCATTCAAAACAGCATAGCAAGTTAAA | 170 |
| | GUUGGAACCAUUCAAAACAGCAUAGCAAGUUAAAAUAAGGCUAGUCCGUUAUCAACUUGAAAAGUGGCACCGAGUCGGUGCUUUUUU | 171 |
| | GTTGGAACCATTCAAAACAGCATAGCAAGTTAAAATAAGGCTAGTCCGTTATCAACTTGAAAAGTGGCACCGAGTCGGTGCTTTTTT | 172 |
| | CAGCATAGCAAGTTAAAATAAGGCTAGTCCGTTATCAACTTGAAAAAGTGGCACCGAGTCGGTGCTTTTTT | 173 |
| | AGCATAGCAAGTTAAAATAAGGCTAGTCCGTTATCAACTTGAAAAAGTGGCACCGAGTCGGTGCTTTTTT | 174 |
| | GCATAGCAAGTTAAAATAAGGCTAGTCCGTTATCAACTTGAAAAAGTGGCACCGAGTCGGTGCTTTTTT | 175 |
| | TAGCAAGTTAAAATAAGGCTAGTCCG | 176 |
| | UAGCAAGUUAAAAUAAGGCUAGUCCG | 177 |
| | GGAACCAUUCAAAACAGCAUAGCAAGUUAAAAU | 178 |
| | GGAACCATTCAAAACAGCATAGCAAGTTAAAAT | 179 |
| | CAAAACAGCAUAGCAAGUUAAAAU | 180 |
| | CAAAACAGCATAGCAAGTTAAAAT | 181 |
| | CAAAACAGCAUAGCAAGUUAAAAUAAGGCUAGUCCGUUAUCAACUUGAAAAGUGGCACCGAGUCGGUGC | 182 |
| | CAAAACAGCATAGCAAGTTAAAATAAGGCTAGTCCGTTATCAACTTGAAAAGTGGCACCGAGTCGGTGC | 183 |

FIG. 19A

| Portion | Sequence (e.g., for use with SauCas9) | SEQ ID NO: |
|---|---|---|
| E | GTTTTAGTACTCTGTAATTTTAGGTATGAGGTAGAC | 184 |
| | GUUUUAGUACUCUGUAAUUUUAGGUAUGAGGUAGAC | 185 |
| | GTTTTAGTACTCTG | 186 |
| | GUUUUAGUACUCUG | 187 |
| | GTTTTAGTACTCT | 188 |
| | GUUUUAGUACUCU | 189 |
| L | GGAAAC | 190 |
| | GGAAA | 191 |
| | GAAA | 192 |
| | TGAA | 193 |
| | UGAA | 194 |
| | AAA | 195 |
| F | ATTGTACTTATACCTAAAATTACAGAATCTACTAAAACAAGGCAAAATGCCGTGTTTATCTCGTCAACTTGTTGGCGAGATTTTT | 196 |
| | AUUGUACUUAUACCUAAAAUUACAGAAUCUACUAAAACAAGGCAAAAUGCCGUGUUUAUCUCGUCAACUUGUUGGCGAGAUUUUU | 197 |
| | ACAGAATCTACTAAAACAAGGCAAAATGCCGTGTTTATCTCGTCAACTTGTTGGCGAGATTTTT | 198 |
| | ACAGAAUCUACUAAAACAAGGCAAAAUGCCGUGUUUAUCUCGUCAACUUGUUGGCGAGAUUUUU | 199 |
| | ACAGAATCTACTAAAACAAGGCAAAATGCCGTGTTTATCTCGTCAACTTGTTGGCGAGATTTTT | 200 |
| | ACAGAATCTACTAAAACAAGGCAAAATGCCGTGTTTATCTCGTCAACTTGTTGGCGAGATTTT | 201 |
| | ACAGAATCTACTAAAACAAGGCAAAATGCCGTGTTTATCTCGTCAACTTGTTGGCGAGATTT | 202 |
| | ACAGAATCTACTAAAACAAGGCAAAATGCCGTGTTTATCTCGTCAACTTGTTGGCGAGATT | 203 |
| | ACAGAATCTACTAAAACAAGGCAAAATGCCGTGTTTATCTCGTCAACTTGTTGGCGAGAT | 204 |
| | CAGAATCTACTAAAACAAGGCAAAATGCCGTGTTTATCTCGTCAACTTGTTGGCGAGATTTTT | 205 |
| | CAGAAUCUACUAAAACAAGGCAAAAUGCCGUGUUUAUCUCGUCAACUUGUUGGCGAGAUUUUU | 206 |
| | CAGAATCTACTAAAACAAGGCAAAATGCCGTGTTTATCTCGTCAACTTGTTGGCGAGATTTT | 207 |
| | CAGAATCTACTAAAACAAGGCAAAATGCCGTGTTTATCTCGTCAACTTGTTGGCGAGATTT | 208 |
| | CAGAATCTACTAAAACAAGGCAAAATGCCGTGTTTATCTCGTCAACTTGTTGGCGAGATT | 209 |
| | CAGAATCTACTAAAACAAGGCAAAATGCCGTGTTTATCTCGTCAACTTGTTGGCGAGAT | 210 |
| | CAGAATCTACTAAAACAAGGCAAAATGCCG | 211 |
| | CAGAATCTACTAAAACAAGGCAAAATGCC | 212 |

FIG. 19B

| Portion | Sequence (e.g., for use with CjeCas9) | SEQ ID NO: |
|---|---|---|
| E | GUUUUAGUCCCUUUUUAAAUUUCUUUAUGGUAAAU | 213 |
| | GTTTTAGTCCCTTTTTAAATTTCTTTATGGTAAAT | 214 |
| | GTTTTAGTCCCTT | 215 |
| | GUUUUAGUCCCUU | 216 |
| | GTTTTAGTCCCT | 217 |
| | GUUUUAGUCCCU | 218 |
| | GTTTTAGTCCC | 219 |
| | GUUUUAGUCCC | 220 |
| L | GAAA | 221 |
| | TGAA | 222 |
| | UGAA | 223 |
| | TGAAA | 224 |
| | TGAAAA | 225 |
| | ATATTCAA | 226 |
| | TGTGGAAATATA | 227 |
| F | AAGAAATTTAAAAAGGGACTAAAATAAAGAGTTTGCGGGACTCTGCGGGGTTACAATCCCCTAAAACCGCTTTT | 228 |
| | AAGAAAUUUAAAAAGGGACUAAAAUAAAGAGUUUGCGGGACUCUGCGGGGUUACAAUCCCCUAAAACCGCUUUU | 229 |
| | AGGGACTAAAATAAAGAGTTTGCGGGACTCTGCGGGGTTACAATCCCCTAAAACCGCTTTTTTT | 230 |
| | AGGGACUAAAAUAAAGAGUUUGCGGGACUCUGCGGGGUUACAAUCCCCUAAAACCGCUUUUUUU | 231 |
| | AGGGACTAAAATAAAGAGTTTGCGGGACTCTGCGGGGTTACAATCCCCTAAAACCGCTTTTTT | 232 |
| | AGGGACTAAAATAAAGAGTTTGCGGGACTCTGCGGGGTTACAATCCCCTAAAACCGCTTTTT | 233 |
| | AGGGACTAAAATAAAGAGTTTGCGGGACTCTGCGGGGTTACAATCCCCTAAAACCGCTTTT | 234 |
| | AGGGACTAAAATAAAGAGTTTGCGGGACTCTGCGGGGTTACAATCCCCTAAAACCGCTTT | 235 |
| | AGGGACTAAAATAAAGAGTTTGCGGGACTCTGCGGGGTTACAATCCCCTAAAACCGCTT | 236 |
| | AGGGACTAAAATAAAGAGTTTGCGGGACTCTGCGGGGTTACAATCCCCTAAAACCGCT | 237 |
| | AGGGACTAAAATAAAGAGTTTGCGGGACTCTGCGGGGTTACAATCCCCTAAAACCGC | 238 |
| | GGGACTAAAATAAAGAGTTTGCGGGACTCTGCGGGGTTACAATCCCCTAAAACCGCTTTTTTT | 239 |
| | GGGACUAAAAUAAAGAGUUUGCGGGACUCUGCGGGGUUACAAUCCCCUAAAACCGCUUUUUUU | 240 |
| | GGGACTAAAATAAAGAGTTTGCGGGACTCTGCGGGGTTACAATCCCCTAAAACCGCTTTTTT | 241 |
| | GGGACTAAAATAAAGAGTTTGCGGGACTCTGCGGGGTTACAATCCCCTAAAACCGCTTTTT | 242 |
| | GGGACTAAAATAAAGAGTTTGCGGGACTCTGCGGGGTTACAATCCCCTAAAACCGCTTTT | 243 |
| | GGGACTAAAATAAAGAGTTTGCGGGACTCTGCGGGGTTACAATCCCCTAAAACCGCTTT | 244 |
| | GGGACTAAAATAAAGAGTTTGCGGGACTCTGCGGGGTTACAATCCCCTAAAACCGCTT | 245 |
| | GGGACTAAAATAAAGAGTTTGCGGGACTCTGCGGGGTTACAATCCCCTAAAACCGCT | 246 |
| | GGGACTAAAATAAAGAGTTTGCGGGACTCTGCGGGGTTACAATCCCCTAAAACCGC | 247 |
| | GGGACTAAAATAAAGAGTTTGCGGGACTCT | 248 |

FIG. 19C

| Portion | Sequence (e.g., for use with SthCas9) | SEQ ID NO: |
|---|---|---|
| E | GTTTTTGTACTCTCAAGATTTAAGTAACTGTACAAC | 249 |
| | GTTTTAGAGCTGTGTTGTTTCGAATGGTTCCAAAAC | 250 |
| | GGTTTGAAACCATTCGAAACAACACAGCGAGTTAAA | 251 |
| | CTTACACAGTTACTTAAATCTTGCAGAAGCTACAAA | 252 |
| | GTTTTTGTACTCTCAAGATTTAAGTAA | 253 |
| | GTTTTTGTACTCTCAAGA | 254 |
| | GTTTTTGTACTCTCAAG | 255 |
| | GTTTTAGAGCTGTGTTGTTTCGAATGG | 256 |
| | GTTTTAGAGCTGTGTTGTTTCGA | 257 |
| | GTTTTAGAGCTGTGTTG | 258 |
| | GGTTTGAAACCATTCGA | 259 |
| | GGTTTGAAACCATTCG | 260 |
| | GUUAUUGUACUCUCAAGAUUUAUUUUU | 261 |
| | GTTATTGTACTCTCAAGATTTATTTTT | 262 |
| | CTTACACAGTTACTTAA | 263 |
| | CTTACACAGTTACTT | 264 |
| L | GAAA | 265 |
| | TAAA | 266 |
| | ATTT | 267 |
| | GTTT | 268 |
| | TTT | 269 |
| | AAA | 270 |
| F | TTACTTAAATCTTGCAGAAGCTACAAAGATAAGGCTTCATGCCGAAATCAACACCCTGTCATTTTATGGCAGGGTGTTTTCGTTATTTAA | 271 |
| | GTAAGGGGCGCCTTACACAGTTACTTAAATCTTGCAGAAGCTACAAAGATAAGGCTTCATGCCGAAATCAACACCCTGTCATTTTATGGCAGGGTGTTTTCGTT | 272 |
| | CTTACACAGTTACTTAAATCTTGCAGAAGCTACAAAGATAAGGCTTCATGCCGAAATCAACACCCTGTCATTTTATGGCAGGGTGTTTTCGTT | 273 |
| | CTTACACAGTTACTTAAATCTTGCAGAAGCTACAAAGATAAGGCTTCATGCCGAAATCAACACCCTGTCATTTTATGGCAGGGTGTTTTT | 274 |
| | CTTACACAGTTACTTAAATCTTGCAGAAGCTACAAAGATAAGGCTTCATGCCGAAATCAACACCCTGTCATTTTATGGCAGGGTG | 275 |
| | CTTACACAGTTACTTAAATCTTGCAGAAGCTACAAA | 276 |
| | TTGTGGTTTGAAACCATTCGAAACAACACAGCGAGTTAAAATAAGGCTTAGTCCGTACTCAACTTGAAAAGGTGGCACCGATTCGGTGTTTTTTTT | 277 |
| | GGTTTGAAACCATTCGAAACAACACAGCGAGTTAAAATAAGGCTTAGTCCGTACTCAACTTGAAAAGGTGGCACCGATTCGGTGTTTTTTTT | 278 |
| | GGTTTGAAACCATTCGAAACAACACAGCGAGTTAAA | 279 |
| | GUUACUUAAAUCUUGCAGAAGCUACAAAGAUAAGGCUUCAUGCCGAAAUCAACACCCUGUCAUUUUAUGGCAGGGUGUUUUCGUUAUUUAA | 280 |
| | GTTACTTAAATCTTGCAGAAGCTACAAAGATAAGGCTTCATGCCGAAATCAACACCCTGTCATTTTATGGCAGGGTGTTTTCGTTATTTAA | 281 |

FIG. 19D

| Portion | Sequence (e.g., for use with FnoCas9) | SEQ ID NO: |
|---|---|---|
| E | UGUUUCAGUUGCGCC | 282 |
| | TGTTTCAGTTGCGCC | 283 |
| | GUUUCAGUUGCUGAAUUAUUUGGUAAACAGUACCAAAUAAUUAAU | 284 |
| | GTTTCAGTTGCTGAATTATTTGGTAAACAGTACCAAATAATTAAT | 285 |
| | GTTTCAGTTGCGCC | 286 |
| | GUUUCAGUUGCGCC | 287 |
| L | GGAAAC | 288 |
| | GGAAA | 289 |
| | GAAA | 290 |
| | GAAAG | 291 |
| | TGAA | 292 |
| | UGAA | 293 |
| | AAA | 294 |
| F | GGCGCUCUGUAAUCAUUUAAAAGUAUUUUGAACGGACCUCUGUUUGACACGUCUG | 295 |
| | GGCGCTCTGTAATCATTTAAAAGTATTTTGAACGGACCTCTGTTTGACACGTCTG | 296 |
| | GCUCUGUAAUCAUUUAAAAGUAUUUUGAACGGACCUCUGUUUGACACGUCUGAAUAACUAAAAAUUUUUUU | 297 |
| | GGCUCUGUAAUCAUUUAAAAGUAUUUUGAACGGACCUCUGUUUGACACGUCUGAAUAACUAAAAAUUUUUUU | 298 |
| | GGCGCUCUGUAAUCAUUUAAAAGUAUUUUGAACGGACCUCUGUUUGACACGUCUGAAUAACUAAAAAUUUUUUU | 299 |
| | GCTCTGTAATCATTTAAAAGTATTTTGAACGGACCTCTGTTTGACACGTCTGAATAACTAAAAATTTTTTT | 300 |
| | GGCTCTGTAATCATTTAAAAGTATTTTGAACGGACCTCTGTTTGACACGTCTGAATAACTAAAAATTTTTTT | 301 |
| | GGCGCTCTGTAATCATTTAAAAGTATTTTGAACGGACCTCTGTTTGACACGTCTGAATAACTAAAAATTTTTTT | 302 |
| | GCTCTGTAATCATTTAAAAGTATTTTGAACGGACCTCTGTTTGACACGTCTGAATAACTAAAAAT | 303 |
| | GGCTCTGTAATCATTTAAAAGTATTTTGAACGGACCTCTGTTTGACACGTCTGAATAACTAAAAAT | 304 |
| | GGCGCTCTGTAATCATTTAAAAGTATTTTGAACGGACCTCTGTTTGACACGTCTGAATAACTAAAAAT | 305 |
| | GGCGCUCUGUAA | 306 |
| | GGCGCTCTGTAA | 307 |

FIG. 19E

| Portion | Sequence (e.g., for use with NmeCas9) | SEQ ID NO: |
|---|---|---|
| E | GTTGTAGCTCCCTTTCTCATTTCG | 308 |
| | GUUGUAGCUCCCUUUCUCAUUUCG | 309 |
| | GUUGUAGCUCCCUUUCUCAUUUCGCAGUGC | 310 |
| | GUUGUAGCUCCCUUUCUC | 311 |
| L | GGAAAC | 312 |
| | GGAAA | 313 |
| | GAAA | 314 |
| | TGAA | 315 |
| | UGAA | 316 |
| | AAA | 317 |
| F | CGAAAUGAGAACCGUUGCUACAAUAAGGCCGUCUGAAAAGAUGUGCCGCAACGCUCUGCCCCUUAAAGCUUCUGCUUUAAGGGGCAUCGUUUA | 318 |
| | CGAAATGAGAACCGTTGCTACAATAAGGCCGTCTGAAAAGATGTGCCGCAACGCTCTGCCCCTTAAAGCTTCTGCTTTAAGGGGCATCGTTTA | 319 |
| | AUAUUGUCGCACUGCGAAAUGAGAACCGUUGCUACAAUAAGGCCGUCUGAAAAGAUGUGCCGCAACGCUCUGCCCCUUAAAGCUUCUGCUUUAAGGGGCAUCGUUUA | 320 |
| | ATTATTGTCGCACTGCGAAATGAGAACCGTTGCTACAATAAGGCCGTCTGAAAAGATGTGCCGCAACGCTCTGCCCCTTAAAGCTTCTGCTTTAAGGGGCATCGTTTA | 321 |
| | AAAUGAGAACCGUUGCUACAAUAAGGCCGUCUGAAAAGAUGUGCCGCAACGCUCUGCCCCUUAAAGCUUCUGCUUUAAGGGGCAUCGUUUA | 322 |
| | AAATGAGAACCGTTGCTACAATAAGGCCGTCTGAAAAGATGTGCCGCAACGCTCTGCCCCTTAAAGCTTCTGCTTTAAGGGGCATCGTTTA | 323 |
| | CGAAAUGAGAACCGUUGCUACAAUAAGGCCGUCUGAAAAGAUGUGCCG | 324 |
| | CGAAATGAGAACCGTTGCTACAATAAGGCCGTCTGAAAAGATGTGCCG | 325 |
| | CGAAAUGAGAACCGUUGCUACAAUAAGGCCG | 326 |
| | CGAAATGAGAACCGTTGCTACAATAAGGCCG | 327 |
| | GCACUGCGAAAUGAGAACCGUUGCUACAAUAAGGCCGUCUGAAAAGAUGUGCCGCAACGCUCUGCCCCUUAAAGCUUCUGC | 328 |
| | GAGAACCGTTGCTACAATAAGGCCGTCTGAAAAGATGTGCCGCAACGCTCTGCCCCTTAAAGCTTCTGCTTTAAGGGGC | 329 |
| | GAGAACCGTTGCTACAATAAGGCCGTCTGAAAAGATGTGCCGCAACGCTCTGCCCCTTAAAGCTTCTGCTTTAAGGGGCTTTTT | 330 |

FIG. 19F

| Portion | Sequence (e.g., for use with GstCas9 or GspCas9) | SEQ ID NO: |
|---|---|---|
| E | GUCAUAGUUCCCCUGA | 331 |
| | GTCATAGTTCCCCTGA | 332 |
| | GUCAUAGUUCCCCUGAGAUUAUCGC | 333 |
| | GTCATAGTTCCCCTGAGATTATCGC | 334 |
| | GUCAUAGUUCCCCUGAGAUUAUCGCUGUGGUAUAAU | 335 |
| | GTCATAGTTCCCCTGAGATTATCGCTGTGGTATAAT | 336 |
| L | GAAA | 337 |
| | TGAA | 338 |
| | UGAA | 339 |
| | AAAA | 340 |
| | AAA | 341 |
| F | UCAGGGUUACUAUGAUAAGGGCUUUCUGCCUAAGGCAGACUGACCCGCGGCGUUGGGGAUCGCCUGUCGCCCGCUUUUGGCGGGCAUUCCC | 342 |
| | TCAGGGTTACTATGATAAGGGCTTTCTGCCTAAGGCAGACTGACCCGCGGCGTTGGGGATCGCCTGTCGCCCGCTTTTGGCGGGCATTCCC | 343 |
| | UCAGGGUUACUAUGAUAAGGGCUUUCUGCCUAAGGCAGACUGACCCGCGGCGUUGGGGAUCGCCUGUCGCCCGCUUUUGGCGGGCAUUCCCCAUCCUU | 344 |
| | TCAGGGTTACTATGATAAGGGCTTTCTGCCTAAGGCAGACTGACCCGCGGCGTTGGGGATCGCCTGTCGCCCGCTTTTGGCGGGCATTCCCCATCCTT | 345 |
| | AUACCACAGCAAUGAUCUCAGGGUUACUAUGAUAAGGGCUUUCUGCCUAAGGCAGACUGACCCGCGGCGUUGGGGAUCGCCUGUCGCCCGCUUUUGGCGGGCAUUCCCCAUCCUU | 346 |
| | ATACCACAGCAATGATCTCAGGGTTACTATGATAAGGGCTTTCTGCCTAAGGCAGACTGACCCGCGGCGTTGGGGATCGCCTGTCGCCCGCTTTTGGCGGGCATTCCCCATCCTT | 347 |
| | AUGAUCUCAGGGUUACUAUGAUAAGGGCUUUCUGCCUAAGGCAGACUGACCCGCGGCGUUGGGGAUCGCCUGUCGCCCGCUUUUGGCGGGCAUUCCCCAUCCUU | 348 |
| | ATGATCTCAGGGTTACTATGATAAGGGCTTTCTGCCTAAGGCAGACTGACCCGCGGCGTTGGGGATCGCCTGTCGCCCGCTTTTGGCGGGCATTCCCCATCCTT | 349 |

FIG. 19G

| | Exemplary synthetic guiding components, (D)-(V)-E-L-F | SEQ ID NO: |
|---|---|---|
| Spy | (D)-(V)-GUUUUAGAGCUA-GAAA-UAGCAAGUUAAAAUAAGGCUAGUCCGUUAUCAACUUGAAAAAGUGGCACCGAGUCGGUGCUUUUUU | 350 |
| | (D)-(V)-GTTTTAGAGCTA-GAAA-TAGCAAGTTAAAATAAGGCTAGTCCGTTATCAACTTGAAAAAGTGGCACCGAGTCGGTGCTTTTTT | 351 |
| | (D)-(V)-GUUUUAGAGCUA-GAAA-UAGCAAGUUAAAAUAAGGCUAGUCCGUUAUCAACUUGAAAAAGUGGCACCGAGUCGGUGCUU | 352 |
| | (D)-(V)-GTTTTAGAGCTA-GAAA-TAGCAAGTTAAAATAAGGCTAGTCCGTTATCAACTTGAAAAAGTGGCACCGAGTCGGTGCTT | 353 |
| | (D)-(V)-GUUUUAGAGCUA-GAAA-UAGCAAGUUAAAAUAAGGCUAGUCCG | 354 |
| | (D)-(V)-GTTTTAGAGCTA-GAAA-TAGCAAGTTAAAATAAGGCTAGTCCG | 355 |
| | (D)-(V)-GUUUUAGAGCUA-GAAA-UAGCAAGUUAAAAUAAGG | 356 |
| | (D)-(V)-GTTTTAGAGCTA-GAAA-TAGCAAGTTAAAATAAGG | 357 |
| Sau | (D)-(V)-GUUUUAGUACUCUG-GAAA-CAGAAUCUACUAAAACAAGGCAAAAUGCCGUGUUUAUCUCGUCAACUUGUUGGCGAGAUUUUU | 358 |
| | (D)-(V)-GTTTTAGTACTCTG-GAAA-CAGAATCTACTAAAACAAGGCAAAATGCCGTGTTTATCTCGTCAACTTGTTGGCGAGATTTTT | 359 |
| | (D)-(V)-GUUUUAGUACUCUG-GAAA-CAGAAUCUACUAAAACAAGGCAAAAUGCCGUGUUUAUCUCGUCAACUUGUUGGCGAGAUUU | 360 |
| | (D)-(V)-GTTTTAGTACTCTG-GAAA-CAGAATCTACTAAAACAAGGCAAAATGCCGTGTTTATCTCGTCAACTTGTTGGCGAGATT | 361 |
| Cje | (D)-(V)-GUUUUAGUCCCU-GAAA-AGGGACUAAAAUAAAAGAGUUUGCGGGACUCUGCGGGGUUACAAUCCCCUAAAACCGC | 362 |
| | (D)-(V)-GTTTTAGTCCCT-GAAA-AGGGACTAAAATAAAAGAGTTTGCGGGACTCTGCGGGGTTACAATCCCCTAAAACCGC | 363 |
| | (D)-(V)-GUUUUAGUCCCU-GAAA-AGGGACUAAAAUAAAAGAGUUUGCGGGACUCUGCGGGGUUACAAUCCCUAAAACCGC | 364 |
| | (D)-(V)-GTTTTAGTCCCT-GAAA-AGGGACTAAAATAAAAGAGTTTGCGGGACTCTGCGGGGTTACAATCCCTAAAACCGC | 365 |
| | (D)-(V)-GUUUUAGUCCCU-GAAA-AGGGACUAAAAUAAAAGAGUUUGCGGGACUCUGCGGGGUUACAAUCCCCUAAAACCGCUUUUUU | 366 |
| | (D)-(V)-GTTTTAGTCCCT-GAAA-AGGGACTAAAATAAAAGAGTTTGCGGGACTCTGCGGGGTTACAATCCCCTAAAACCGCTTTTTT | 367 |
| | (D)-(V)-GUUUUAGUCCC-TGAA-GGGACUAAAAUAAAAGAGUUUGCGGGACUCUGCGGGGUUACAAUCCCCUAAAACCGCUUUUUU | 368 |
| | (D)-(V)-GTTTTAGTCCCT-TGTGGAAATATA-AGGGACTAAAATAAAAGAGTTTGCGGGACTCTGCGGGGTTACAATCCCCTAAAACCGCTTTTTT | 369 |
| Sth | (D)-(V)-GUUUUAGUCCCU-ATATTCAA-AGGGACUAAAAUAAAAGAGAGUUGCGGGACUUCAUGCCGAAAUCAACACCCUGUCAUUUUAUGGCAGGGUGUUUCGUUAUUUAA | 370 |
| | (D)-(V)-GTTTTGTACTCTCAAGA-TAAA-TGCAGAAGCTACAAAGATAAGGCTTCATGCCGAAATCAACACCCTGTCATTTTATGGCAGGGTGTTTCGTTATTTAA | 371 |
| | (D)-(V)-GTTTTGTACTCTCAAGA-TTAA-TGCAGAAGCTACAAAGATAAGGCTTCATGCCGAAATCAACACCCTGTCATTTTATGGCAGGGTGTTTT | 372 |
| | (D)-(V)-GTTTTGTACTCTCAAGA-TAAA-TGCAGAAGCTACAAAGATAAGGCTTCATGCCGAAATCAACACCCTGTCATTTTATGGCAGGGTGTTTT | 373 |
| | (D)-(V)-GTTTTAGAGCTGTGTTGTTT-GTTA-AAACAACACAGCGAGTAAAATAAGGCTTAGTCCGTACTCAACTTGAAAAGGTGGCACCACCGATTCGGTGTTTTT | 374 |

FIG. 20A

| | Exemplary synthetic guiding components, (D)-(V)-E-L-F | SEQ ID NO: |
|---|---|---|
| Fno | (D)-(V)-GUUUCAGUUGCGCC-GAAA-GGCGCUCUGUAAUCAUUAAAAGUAUUUUGAACGGACCUCUGUUUGACACGUCUG | 375 |
| | (D)-(V)-GUUUCAGUUGCGCC-GAAA-GGCGCUCUGUAA | 376 |
| | (D)-(V)-GTTTCAGTTGCGCC-GAAA-GGCGCTCTGTAA | 377 |
| Nme | (D)-(V)-GUUGUAGCUCCCUUUCUC-GAAA-GAGAACCGUUGCUACAAUAAGGCCGUCUGAAAAGAUGUGCCGCAACGCUCUGCCCCUUAAAGCUUCUGCUUUAAGGGGC TTTTT | 378 |
| | (D)-(V)-GUUGUAGCUCCCUUUCUC-GAAA-GAGAACCGUUGCUACAAUAAGGCCGUCUGAAAAGAUGUGCCGCAACGCUCUGCCCCUUAAAGCUUCUGCUUUAAGGGGC | 379 |
| Gst or Gsp | (D)-(V)-GUCAUAAGUUCCCCUGA-GAAA-UCAGGGUUACUAUGAUAAGGGCUUUCUGCCUAAGGCAGACUGAGACUGACCGCGGCGUUGGGGAUCGCCUGUCGCCGCUUUUGGCGGGCAUUCCC | 380 |
| | (D)-(V)-GUCAUAAGUUCCCCUGA-GAAA-UCAGGGUUACUAUGAUAAGGGCUUUCUGCCUAAGGCAGACUGAGACUGACCGCGGCGUUGGGGAUCGCCUGUCGCCGCUUUUGGCGGGCAUUCCCCAUCCUU | 381 |
| | (D)-(V)-GTCATAGTTCCCCTGA-GAAA-TCAGGGTTACTATGATAAGGGCTTTCTGCCTAAGGCAGACTGAGACTGACCGCGGCGTTGGGGATCGCCTGTCGCCGCTTTTGGCGGGCATTCCC | 382 |
| | (D)-(V)-GTCATAGTTCCCCTGA-GAAA-TCAGGGTTACTATGATAAGGGCTTTCTGCCTAAGGCAGACTGAGACTGACCGCGGCGTTGGGGATCGCCTGTCGCCGCTTTTGGCGGGCATTCCCCATCCTT | 383 |
| | (D)-(V)-GUCAUAAGUUCCCCUGAGAGAUUAUCGCGCUGUGCCGCCUGUCGCCGGUUAUAU-GAAA-AUACCACAGCAAUGAUCUCAGGGUUACUAUGAUAAGGGCUUUCUGCCUAAGGCAGACUGAGACUGACCGCGGCGUUGGGGAUCGCCUGUCGCCUUUUGGCGGGCAUUCCCCAUCCUU | 384 |
| | (D)-(V)-GTCATAGTTCCCTGAGATTATGCTGTGATAAT-GAAA-ATACCACAGCAATGATCTCAGGGTTACTATGATAAGGGCTTTCTGCCTAAGGCAGACTGAGACTGACCGCGGCGTTGGGGATCGCCTGTCGCCGCTTGTGGCGGGATCGCCTGTCGCCGCTTGTGGGGATCGCCTGTCGCCGCTTTTGGCGGGCATTCCCCATCCTT | 385 |
| | (D)-(V)- GUCAUAGUUCCCCUGAGAUUAUCGC-GAAA-AUGAUCUCAGGGUUACUAUGAUAAGGGCUUUCUGCCUAAGGCAGACUGAGACUGACCGCGGCGUUGGGGAUCGCCUGUCGCCCCGCUUUUGGCGGGCAUUCCCCAUCCUU | 386 |
| | (D)-(V)- GTCATAGTTCCCTGAGATTATCGC-GAAA-ATGATCTCAGGGTTACTATGATAAGGGCTTTCTGCCTAAGGCAGACTGACCGCGGCGTTGGGGATCGCCTGTCGCCCCGCTTTTGGCGGGCATTCCCCATCTT | 387 |

FIG. 20B

| | Exemplary target strands, X-Y-(T)-Z, where (L) indicates label | SEQ ID NO: |
|---|---|---|
| Spy | TGTACT-CCA-(T)-AGCAGAGATTTCTGCTGTGC | 388 |
| | (L)-TGTACT-CCA-(T)-AGCAGAGATTTCTGCTGTGC | 389 |
| | AGCAAGCTGACGTTTGTACT-CCA-(T)-AGCAGAGATTTCTGCTGTGC | 390 |
| | (L)-AGCAAGCTGACGTTTGTACT-CCA-(T)-AGCAGAGATTTCTGCTGTGC | 391 |
| Sau | TGT-ACTCCA-(T)-AGCAGAGATTTCTGCTGTGC | 392 |
| | (L)-TGT-ACTCCA-(T)-AGCAGAGATTTCTGCTGTGC | 393 |
| | TGTC-ACTC-(T)-AGCAGAGATTTCTGCTGTGC | 394 |
| | (L)-TGTC-ACTC-(T)-AGCAGAGATTTCTGCTGTGC | 395 |
| Cje | TCCG-TGTTCAC-(T)-AGCAGAGATTTCTGCTGTGC | 396 |
| | (L)-TCCG-TGTTCAC-(T)-AGCAGAGATTTCTGCTGTGC | 397 |
| | TCCG-GTGTCCCC-(T)-AGCAGAGATTTCTGCTGTGC | 398 |
| | (L)-TCCG-GTGTCCCC-(T)-AGCAGAGATTTCTGCTGTGC | 399 |

FIG. 21A

| | Exemplary non-target strands, A-(U)-B-C, where (L) indicates label | SEQ ID NO: |
|---|---|---|
| Spy | GCACAGCAGAAATCTCTGCT-(U)-TGG-AGTA | 400 |
| | GCACAGCAGAAATCTCTGCT-(U)-TGG-AGTACA | 401 |
| | GCACAGCAGAAATCTCTGCT-(U)-TGG-AGAGCAAACGTCAGC | 402 |
| | GCACAGCAGAAATCTCTGCT-(U)-TGG-AGTACAAACGTCAGC | 403 |
| | GCACAGCAGAAATCTCTGCT-(U)-TGG-AGTA-(L) | 404 |
| | GCACAGCAGAAATCTCTGCT-(U)-TGG-AGTACA-(L) | 405 |
| | GCACAGCAGAAATCTCTGCT-(U-(L))-TGG-AGT(L)ACAAACGTCAGC-(L) | 406 |
| | GCACAGCAGAAATCTCTGCT-(U-(L))-TGG-AG(L)ACAAACGTCAGC-(L) | 407 |
| Sau | GCACAGCAGAAATCTCT-(U)-TGGAGT-A | 408 |
| | TCACAGCAGAAATCTCTGCT-(U)-TGGAGT-A | 409 |
| | GCACAGCAGAAATCTCT-(U)-TGGAGT-ACA | 410 |
| | GCACAGCAGAAATCTCT-(U)-TGGAGT-A-(L) | 411 |
| | TCACAGCAGAAATCTCTGCT-(U)-TGGAGT-A-(L) | 412 |
| | GCACAGCAGAAATCTCT-(U)-TGGAGT-ACA-(L) | 413 |
| Cje | GCACAGCAGAAATCTCT-(U)-GTGAACA-CG | 414 |
| | GCACAGCAGAAATCTCT-(U)-GTGAACA-CGGA | 415 |
| | GCACAGCAGAAATCTCT-(U)-GTGAACA-CG-(L) | 416 |
| | GCACAGCAGAAATCTCT-(U)-GTGAACA-CGGA-(L) | 417 |

FIG. 21B

FnoCas12a (*Francisella novicida* U112 Cas12a (FnCpf1), SEQ ID NO:420)
```
   1 MSIYQEFVNK YSLSKTLRFE LIPQGKTLEN IKARGLILDD EKRAKDYKKA KQIIDKYHQF
  61 FIEEILSSVC ISEDLLQNYS DVYFKLKKSD DDNLQKDFKS AKDTIKKQIS EYIKDSEKFK
 121 NLFNQNLIDA KKGQESDLIL WLKQSKDNGI ELFKANSDIT DIDEALEIIK SFKGWTTYFK
 181 GFHENRKNVY SSNDIPTSII YRIVDDNLPK FLENKAKYES LKDKAPEAIN YEQIKKDLAE
 241 ELTFDIDYKT SEVNQRVFSL DEVFEIANFN NYLNQSGITK FNTIIGGKFV NGENTKRKGI
 301 NEYINLYSQQ INDKTLKKYK MSVLFKQILS DTESKSFVID KLEDDSDVVT TMQSFYEQIA
 361 AFKTVEEKSI KETLSLLFDD LKAQKLDLSK IYFKNDKSLT DLSQQVFDDY SVIGTAVLEY
 421 ITQQIAPKNL DNPSKKEQEL IAKKTEKAKY LSLETIKLAL EEFNKHRDID KQCRFEEILA
 481 NFAAIPMIFD EIAQNKDNLA QISIKYQNQG KKDLLQASAE DDVKAIKDLL DQTNNLLHKL
 541 KIFHISQSED KANILDKDEH FYLVFEECYF ELANIVPLYN KIRNYITQKP YSDEKFKLNF
 601 ENSTLANGWD KNKEPDNTAI LFIKDDKYYL GVMNKKNNKI FDDKAIKENK GEGYKKIVYK
 661 LLPGANKMLP KVFFSAKSIK FYNPSEDILR IRNHSTHTKN GSPQKGYEKF EFNIEDCRKF
 721 IDFYKQSISK HPEWKDFGFR FSDTQRYNSI DEFYREVENQ GYKLTFENIS ESYIDSVVNQ
 781 GKLYLFQIYN KDFSAYSKGR PNLHTLYWKA LFDERNLQDV VYKLNGEAEL FYRKQSIPKK
 841 ITHPAKEAIA NKNKDNPKKE SVFEYDLIKD KRFTEDKFFF HCPITINFKS SGANKFNDEI
 901 NLLLKEKAND VHILSIDRGE RHLAYYTLVD GKGNIIKQDT FNIIGNDRMK TNYHDKLAAI
 961 EKDRDSARKD WKKINNIKEM KEGYLSQVVH EIAKLVIEYN AIVVFEDLNF GFKRGRFKVE
1021 KQVYQKLEKM LIEKLNYLVF KDNEFDKTGG VLRAYQLTAP FETFKKMGKQ TGIIYYVPAG
1081 FTSKICPVTG FVNQLYPKYE SVSKSQEFFS KFDKICYNLD KGYFEFSFDY KNFGDKAAKG
1141 KWTIASFGSR LINFRNSDKN HNWDTREVYP TKELEKLLKD YSIEYGHGEC IKAAICGESD
1201 KKFFAKLTSV LNTILQMRNS KTGTELDYLI SPVADVNGNF FDSRQAPKNM PQDADANGAY
1261 HIGLKGLMLL GRIKNNQEGK KLNLVIKNEE YFEFVQNRNN
```

FIG. 24A

AspCas12a (*Acidaminococcus* sp. Cas 12a (AsCpf1), SEQ ID NO:421)
```
   1 MTQFEGFTNL YQVSKTLRFE LIPQGKTLKH IQEQGFIEED KARNDHYKEL KPIIDRIYKT
  61 YADQCLQLVQ LDWENLSAAI DSYRKEKTEE TRNALIEEQA TYRNAIHDYF IGRTDNLTDA
 121 INKRHAEIYK GLFKAELFNG KVLKQLGTVT TTEHENALLR SFDKFTTYFS GFYENRKNVF
 181 SAEDISTAIP HRIVQDNFPK FKENCHIFTR LITAVPSLRE HFENVKKAIG IFVSTSIEEV
 241 FSFPFYNQLL TQTQIDLYNQ LLGGISREAG TEKIKGLNEV LNLAIQKNDE TAHIIASLPH
 301 RFIPLFKQIL SDRNTLSFIL EEFKSDEEVI QSFCKYKTLL RNENVLETAE ALFNELNSID
 361 LTHIFISHKK LETISSALCD HWDTLRNALY ERRISELTGK ITKSAKEKVQ RSLKHEDINL
 421 QEIISAAGKE LSEAFKQKTS EILSHAHAAL DQPLPTTLKK QEEKEILKSQ LDSLLGLYHL
 481 LDWFAVDESN EVDPEFSARL TGIKLEMEPS LSFYNKARNY ATKKPYSVEK FKLNFQMPTL
 541 ASGWDVNKEK NNGAILFVKN GLYYLGIMPK QKGRYKALSF EPTEKTSEGF DKMYYDYFPD
 601 AAKMIPKCST QLKAVTAHFQ THTTPILLSN NFIEPLEITK EIYDLNNPEK EPKKFQTAYA
 661 KKTGDQKGYR EALCKWIDFT RDFLSKYTKT TSIDLSSLRP SSQYKDLGEY YAELNPLLYH
 721 ISFQRIAEKE IMDAVETGKL YLFQIYNKDF AKGHHGKPNL HTLYWTGLFS PENLAKTSIK
 781 LNGQAELFYR PKSRMKRMAH RLGEKMLNKK LKDQKTPIPD TLYQELYDYV NHRLSHDLSD
 841 EARALLPNVI TKEVSHEIIK DRRFTSDKFF FHVPITLNYQ AANSPSKFNQ RVNAYLKEHP
 901 ETPIIGIDRG ERNLIYITVI DSTGKILEQR SLNTIQQFDY QKKLDNREKE RVAARQAWSV
 961 VGTIKDLKQG YLSQVIHEIV DLMIHYQAVV VLENLNFGFK SKRTGIAEKA VYQQFEKMLI
1021 DKLNCLVLKD YPAEKVGGVL NPYQLTDQFT SFAKMGTQSG FLFYVPAPYT SKIDPLTGFV
1081 DPFVWKTIKN HESRKHFLEG FDFLHYDVKT GDFILHFKMN RNLSFQRGLP GFMPAWDIVF
1141 EKNETQFDAK GTPFIAGKRI VPVIENHRFT GRYRDLYPAN ELIALLEEKG IVFRDGSNIL
1201 PKLLENDDSH AIDTMVALIR SVLQMRNSNA ATGEDYINSP VRDLNGVCFD SRFQNPEWPM
1261 DADANGAYHI ALKGQLLLNH LKESKDLKLQ NGISNQDWLA YIQELRN
```

FIG. 24B

```
LbaCas12a (Lachnospiraceae bacterium ND2006 Cas12a (LbCpf1), SEQ ID NO:422)
   1 MSKLEKFTNC YSLSKTLRFK AIPVGKTQEN IDNKRLLVED EKRAEDYKGV KKLLDRYYLS
  61 FINDVLHSIK LKNLNNYISL FRKKTRTEKE NKELENLEIN LRKEIAKAFK GAAGYKSLFK
 121 KDIIETILPE AADDKDEIAL VNSFNGFTTA FTGFFDNREN MFSEEAKSTS IAFRCINENL
 181 TRYISNMDIF EKVDAIFDKH EVQEIKEKIL NSDYDVEDFF EGEFFNFVLT QEGIDVYNAI
 241 IGGFVTESGE KIKGLNEYIN LYNAKTKQAL PKFKPLYKQV LSDRESLSFY GEGYTSDEEV
 301 LEVFRNTLNK NSEIFSSIKK LEKLFKNFDE YSSAGIFVKN GPAISTISKD IFGEWNLIRD
 361 KWNAEYDDIH LKKKAVVTEK YEDDRRKSFK KIGSFSLEQL QEYADADLSV VEKLKEIIIQ
 421 KVDEIYKVYG SSEKLFDADF VLEKSLKKND AVVAIMKDLL DSVKSFENYI KAFFGEGKET
 481 NRDESFYGDF VLAYDILLKV DHIYDAIRNY VTQKPYSKDK FKLYFQNPQF MGGWDKDKET
 541 DYRATILRYG SKYYLAIMDK KYAKCLQKID KDDVNGNYEK INYKLLPGPN KMLPKVFFSK
 601 KWMAYYNPSE DIQKIYKNGT FKKGDMFNLN DCHKLIDFFK DSISRYPKWS NAYDFNFSET
 661 EKYKDIAGFY REVEEQGYKV SFESASKKEV DKLVEEGKLY MFQIYNKDFS DKSHGTPNLH
 721 TMYFKLLFDE NNHGQIRLSG GAELFMRRAS LKKEELVVHP ANSPIANKNP DNPKKTTTLS
 781 YDVYKDKRFS EDQYELHIPI AINKCPKNIF KINTEVRVLL KHDDNPYVIG IDRGERNLLY
 841 IVVVDGKGNI VEQYSLNEII NNFNGIRIKT DYHSLLDKKE KERFEARQNW TSIENIKELK
 901 AGYISQVVHK ICELVEKYDA VIALEDLNSG FKNSRVKVEK QVYQKFEKML IDKLNYMVDK
 961 KSNPCATGGA LKGYQITNKF ESFKSMSTQN GFIFYIPAWL TSKIDPSTGF VNLLKTKYTS
1021 IADSKKFISS FDRIMYVPEE DLFEFALDYK NFSRTDADYI KKWKLYSYGN RIRIFAAAKK
1081 NNVFAWEEVC LTSAYKELFN KYGINYQQGD IRALLCEQSD KAFYSSFMAL MSLMLQMRNS
1141 ITGRTDVDFL ISPVKNSDGI FYDSRNYEAQ ENAILPKNAD ANGAYNIARK VLWAIGQFKK
1201 AEDEKLDKVK IAISNKEWLE YAQTSVKH
```

FIG. 24C

| Portion | Sequence (e.g., for use with FnoCas12a) | SEQ ID NO: |
|---|---|---|
| F | AAUUUCUAC | 425 |
| | AATTTCTAC | 426 |
| | AAUUUCUGC | 427 |
| | AATTTCTGC | 428 |
| | AAUUUCCAC | 429 |
| | AATTTCCAC | 430 |
| | AAUUCCUAC | 431 |
| | AATTCCTAC | 432 |
| | UAAUUUCUA | 433 |
| | TAATTTCTA | 434 |
| L | UGUU | 435 |
| | TGTT | 436 |
| | UCUU | 437 |
| | TCTT | 438 |
| | UAUU | 439 |
| | TATT | 440 |
| | UGCU | 441 |
| | TGCT | 442 |
| | UUU | 443 |
| | TTT | 444 |
| E | GUAGAU | 445 |
| | GTAGAT | 446 |
| | GCAGAU | 447 |
| | GCAGAT | 448 |
| | GUGGAU | 449 |
| | GTGGAT | 450 |
| | GUAGGU | 451 |
| | GTAGGT | 452 |
| | AAUUUCUACUGUUGUAGAU | 453 |
| | AATTTCTACTGTTGTAGAT | 454 |
| | AAUUUCUGCUGUUGCAGAU | 455 |
| | AATTTCTGCTGTTGCAGAT | 456 |
| | AAUUUCCACUGUUGUGGAU | 457 |
| | AATTTCCACTGTTGTGGAT | 458 |
| | AAUUCCUACUGUUGUAGGU | 459 |
| | AATTCCTACTGTTGTAGGT | 460 |
| | UAAUUUCUACUGUUGUAGAU | 461 |
| | TAATTTCTACTGTTGTAGAT | 462 |

FIG. 25A

| Portion | Sequence (e.g., for use with AspCas12a) | SEQ ID NO: |
|---|---|---|
| F | AAUUUCUAC | 463 |
| | AATTTCTAC | 464 |
| | UAAUUUCUAC | 465 |
| | TAATTTCTAC | 466 |
| | AAUUUCUGC | 467 |
| | AATTTCTGC | 468 |
| | AAUUUCCAC | 469 |
| | AATTTCCAC | 470 |
| | AAUUCCUAC | 471 |
| | AATTCCTAC | 472 |
| | UAAUUUCUA | 473 |
| | TAATTTCTA | 474 |
| L | UGUU | 475 |
| | TGTT | 476 |
| | UCUU | 477 |
| | TCTT | 478 |
| | UAUU | 479 |
| | TATT | 480 |
| | UGCU | 481 |
| | TGCT | 482 |
| | UUU | 483 |
| | TTT | 484 |
| E | GUAGAU | 485 |
| | GTAGAT | 486 |
| | GCAGAU | 487 |
| | GCAGAT | 488 |
| | GUGGAU | 489 |
| | GTGGAT | 490 |
| | GUAGGU | 491 |
| | GTAGGT | 492 |
| | AAUUUCUACUCUUGUAGAU | 493 |
| | AATTTCTACTCTTGTAGAT | 494 |
| | UAAUUUCUACUCUUGUAGAU | 495 |
| | TAATTTCTACTCTTGTAGAT | 496 |
| D | AACC | 497 |

FIG. 25B

| Portion | Sequence (e.g., for use with LbaCas12a) | SEQ ID NO: |
|---|---|---|
| F | AAUUUCUAC | 498 |
| | AATTTCTAC | 499 |
| | UAAUUUCUAC | 500 |
| | TAATTTCTAC | 501 |
| | AAUUUCUGC | 502 |
| | AATTTCTGC | 503 |
| | GAAUUUCUAC | 504 |
| | GAATTTCTAC | 505 |
| | UAAUUUCUA | 506 |
| | TAATTTCTA | 507 |
| L | UAAGU | 508 |
| | TAAGT | 509 |
| | UGUU | 510 |
| | TGTT | 511 |
| | UCUU | 512 |
| | TCTT | 513 |
| | UAUU | 514 |
| | TATT | 515 |
| | UGCU | 516 |
| | TGCT | 517 |
| | UUU | 518 |
| | TTT | 519 |
| E | GUAGAU | 520 |
| | GTAGAT | 521 |
| | GCAGAU | 522 |
| | GCAGAT | 523 |
| | GUGGAU | 524 |
| | GTGGAT | 525 |
| | GUAGGU | 526 |
| | GTAGGT | 527 |
| | AAUUUCUACUAAGUGUAGAU | 528 |
| | AATTTCTACTAAGTGTAGAT | 529 |
| | AAUUUCUACUAUUGUAGAU | 530 |
| | AATTTCTACTATTGTAGAT | 531 |
| | GAAUUUCUACUAUUGUAGAU | 532 |
| | GAATTTCTACTATTGTAGAT | 533 |
| | UAAUUUCUACUAAGUGUAGAU | 534 |
| | TAATTTCTACTAAGTGTAGAT | 535 |
| D | AACC | 536 |

FIG. 25C

|  | Exemplary synthetic guiding components, F-L-E-(V)-(D) or E-(V)-(D) | SEQ ID NO: |
|---|---|---|
| Fno | AAUUUCUAC-UGUU-GUAGAU-(V)-(D) | 537 |
|  | AATTTCTAC-TGTT-GTAGAT-(V)-(D) | 538 |
|  | AAUUUCUGC-UGUU-GCAGAU-(V)-(D) | 539 |
|  | AATTTCTGC-TGTT-GCAGAT-(V)-(D) | 540 |
|  | AAUUUCCAC-UGUU-GUGGAU-(V)-(D) | 541 |
|  | AATTTCCAC-TGTT-GTGGAT-(V)-(D) | 542 |
|  | AAUUCCUAC-UGUU-GUAGGU-(V)-(D) | 543 |
|  | AATTCCTAC-TGTT-GTAGGT-(V)-(D) | 544 |
|  | UAAUUUCUAC-UGUU-GUAGAU-(V)-(D) | 545 |
|  | TAATTTCTAC-TGTT-GTAGAT-(V)-(D) | 546 |
| Asp | AAUUUCUAC-UCUU-GUAGAU-(V)-AACC | 547 |
|  | AATTTCTAC-TCTT-GTAGAT-(V)-AACC | 548 |
|  | UAAUUUCUAC-UCUU-GUAGAU-(V)-(D) | 549 |
|  | TAATTTCTAC-TCTT-GTAGAT-(V)-(D) | 550 |
|  | AAUUUCUAC-UCUU-GUAGAU-(V)-(D) | 551 |
|  | AATTTCTAC-TCTT-GTAGAT-(V)-(D) | 552 |
| Lba | AAUUUCUAC-UAAGU-GUAGAU-(V)-AACC | 553 |
|  | AATTTCTAC-TAAGT-GTAGAT-(V)-AACC | 554 |
|  | AAUUUCUAC-UAAGU-GUAGAU-(V)-(D) | 555 |
|  | AATTTCTAC-TAAGT-GTAGAT-(V)-(D) | 556 |
|  | AAUUUCUAC-UAUU-GUAGAU-(V)-(D) | 557 |
|  | AATTTCTAC-TATT-GTAGAT-(V)-(D) | 558 |
|  | GAAUUUCUAC-UAUU-GUAGAU-(V)-(D) | 559 |
|  | GAATTTCTAC-TATT-GTAGAT-(V)-(D) | 560 |
|  | UAAUUUCUAC-UAAGU-GUAGAU-(V)-AACC | 561 |
|  | TAATTTCTAC-TAAGT-GTAGAT-(V)-AACC | 562 |
|  | UAAUUUCUAC-UAAGU-GUAGAU-(V)-(D) | 563 |
|  | TAATTTCTAC-TAAGT-GTAGAT-(V)-(D) | 564 |

FIG. 26

```
AacCas12b (Alicyclobacillus acidiphilus Cas12b, SEQ ID NO:570)
   1 MAVKSMKVKL RLDNMPEIRA GLWKLHTEVN AGVRYYTEWL SLLRQENLYR RSPNGDGEQE
  61 CYKTAEECKA ELLERLRARQ VENGHCGPAG SDDELLQLAR QLYELLVPQA IGAKGDAQQI
 121 ARKFLSPLAD KDAVGGLGIA KAGNKPRWVR MREAGEPGWE EEKAKAEARK STDRTADVLR
 181 ALADFGLKPL MRVYTSDSMS SVQWKPLRKG QAVRTWDRDM FQQAIERMMS WESWNQRVGE
 241 AYAKLVEQKS RFEQKNFVGQ EHLVQLVNQL QQDMKEASHG LESKEQTAHY LTGRALRGSD
 301 KVFEKWEKLD PDAPFDLYDT EIKNVQRRNT RRFGSHDLFA KLAEPKYQAL WREDASFLTR
 361 YAVYNSIVRK LNHAKMFATF TLPDATAHPI WTRFDKLGGN LHQYTFLFNE FGEGRHAIRF
 421 QKLLTVEDGV AKEVDDVTVP ISMSAQLDDL LPRDPHELVA LYFQDYGAEQ HLAGEFGGAK
 481 IQYRRDQLNH LHARRGARDV YLNLSVRVQS QSEARGERRP PYAAVFRLVG DNHRAFVHFD
 541 KLSDYLAEHP DDGKLGSEGL LSGLRVMSVD LGLRTSASIS VFRVARKDEL KPNSEGRVPF
 601 CFPIEGNENL VAVHERSQLL KLPGETESKD LRAIREERQR TLRQLRTQLA YLRLLVRCGS
 661 EDVGRRERSW AKLIEQPMDA NQMTPDWREA FEDELQKLKS LYGICGDREW TEAVYESVRR
 721 VWRHMGKQVR DWRKDVRSGE RPKIRGYQKD VVGGNSIEQI EYLERQYKFL KSWSFFGKVS
 781 GQVIRAEKGS RFAITLREHI DHAKEDRLKK LADRIIMEAL GYVYALDDER GKGKWVAKYP
 841 PCQLILLEEL SEYQFNNDRP PSENNQLMQW SHRGVFQELL NQAQVHDLLV GTMYAAFSSR
 901 FDARTGAPGI RCRRVPARCA REQNPEPFPW WLNKFVAEHK LDGCPLRADD LIPTGEGEFF
 961 VSPFSAEEGD FHQIHADLNA AQNLQRRLWS DFDISQIRLR CDWGEVDGEP VLIPRTTGKR
1021 TADSYGNKVF YTKTGVTYYE RERGKKRRKV FAQEELSEEE AELLVEADEA REKSVVLMRD
1081 PSGIINRGDW TRQKEFWSMV NQRIEGYLVK QIRSRVRLQE SACENTGDI
```

FIG. 27A

```
AatCas12b (Alicyclobacillus acidoterrestris (strain ATCC 49025/DSM 3922/CIP
106132/NCIMB 13137/GD3B) Cas12b, SEQ ID NO:571)
    1 MAVKSIKVKL RLDDMPEIRA GLWKLHKEVN AGVRYYTEWL SLLRQENLYR RSPNGDGEQE
   61 CDKTAEECKA ELLERLRARQ VENGHRGPAG SDDELLQLAR QLYELLVPQA IGAKGDAQQI
  121 ARKFLSPLAD KDAVGGLGIA KAGNKPRWVR MREAGEPGWE EEKEKAETRK SADRTADVLR
  181 ALADFGLKPL MRVYTDSEMS SVEWKPLRKG QAVRTWDRDM FQQAIERMMS WESWNQRVGQ
  241 EYAKLVEQKN RFEQKNFVGQ EHLVHLVNQL QQDMKEASPG LESKEQTAHY VTGRALRGSD
  301 KVFEKWGKLA PDAPFDLYDA EIKNVQRRNT RRFGSHDLFA KLAEPEYQAL WREDASFLTR
  361 YAVYNSILRK LNHAKMFATF TLPDATAHPI WTRFDKLGGN LHQYTFLFNE FGERRHAIRF
  421 HKLLKVENGV AREVDDVTVP ISMSEQLDNL LPRDPNEPIA LYFRDYGAEQ HFTGEFGGAK
  481 IQCRRDQLAH MHRRRGARDV YLNVSVRVQS QSEARGERRP PYAAVFRLVG DNHRAFVHFD
  541 KLSDYLAEHP DDGKLGSEGL LSGLRVMSVD LGLRTSASIS VFRVARKDEL KPNSKGRVPF
  601 FFPIKGNDNL VAVHERSQLL KLPGETESKD LRAIREERQR TLRQLRTQLA YLRLLVRCGS
  661 EDVGRRERSW AKLIEQPVDA ANHMTPDWRE AFENELQKLK SLHGICSDKE WMDAVYESVR
  721 RVWRHMGKQV RDWRKDVRSG ERPKIRGYAK DVVGGNSIEQ IEYLERQYKF LKSWSFFGKV
  781 SGQVIRAEKG SRFAITLREH IDHAKEDRLK KLADRIIMEA LGYVYALDER GKGKWVAKYP
  841 PCQLILLEEL SEYQFNNDRP PSENNQLMQW SHRGVFQELI NQAQVHDLLV GTMYAAFSSR
  901 FDARTGAPGI RCRRVPARCT QEHNPEPFPW WLNKFVVEHT LDACPLRADD LIPTGEGEIF
  961 VSPFSAEEGD FHQIHADLNA AQNLQQRLWS DFDISQIRLR CDWGEVDGEL VLIPRLTGKR
 1021 TADSYSNKVF YTNTGVTYYE RERGKKRRKV FAQEKLSEEE AELLVEADEA REKSVVLMRD
 1081 PSGIINRGNW TRQKEFWSMV NQRIEGYLVK QIRSRVPLQD SACENTGDI
```

FIG. 27B

```
AkaCas12b (Alicyclobacillus kakegawensis Cas12b, SEQ ID NO:572)
    1 MAVKSIKVKL RLSECPDILA GMWQLHRATN AGVRYYTEWV SLMRQEILYS RGPDGGQQCY
   61 MTAEDCQREL LRRLRNRQLH NGRQDQPGTD ADLLAISRRL YEILVLQSIG KRGDAQQIAS
  121 SFLSPLVDPN SKGGRGEAKS GRKPAWQKMR DQGDPRWVAA REKYEQRKAV DPSKEILNSL
  181 DALGLRPLFA VFTETYRSGV DWKPLGKSQG VRTWDRDMFQ QALERLMSWE SWNRRVGEEY
  241 ARLFQQKMKF EQEHFAEQSH LVKLARALEA DMRAASQGFE AKRGTAHQIT RRALRGADRV
  301 FEIWKSIPEE ALFSQYDEVI RQVQAEKRRD FGSHDLFAKL AEPKYQPLWR ADETFLTRYA
  361 LYNGVLRDLE KARQFATFTL PDACVNPIWT RFESSQGSNL HKYEFLFDHL GPGRHAVRFQ
  421 RLLVVESEGA KERDSVVVPV APSGQLDKLV LREEEKSSVA LHLHDTARPD GFMAEWAGAK
  481 LQYERSTLAR KARRDKQGMR SWRRQPSMLM SAAQMLEDAK QAGDVYLNIS VRVKSPSEVR
  541 GQRRPPYAAL FRIDDKQRRV TVNYNKLSAY LEEHPDKQIP GAPGLLSGLR VMSVDLGLRT
  601 SASISVFRVA KKEEVEALGD GRPPHYYPIH GTDDLVAVHE RSHLIQMPGE TETKQLRKLR
  661 EERQAVLRPL FAQLALLRLL VRCGAADERI RTRSWQRLTK QGREFTKRLT PSWREALELE
  721 LTRLEAYCGR VPDDEWSRIV DRTVIALWRR MGKQVRDWRK QVKSGAKVKV KGYQLDVVGG
  781 NSLAQIDYLE QQYKFLRRWS FFARASGLVV RADRESHFAV ALRQHIENAK RDRLKKLADR
  841 ILMEALGYVY EASGPREGQW TAQHPPCQLI ILEELSAYRF SDDRPPSENS KLMAWGHRGI
  901 LEELVNQAQV HDVLVGTVYA AFSSRFDART GAPGVRCRRV PARFVGATVD DSLPLWLTEF
  961 LDKHRLDKNL LRPDDVIPTG EGEFLVSPCG EEAARVRQVH ADINAAQNLQ RRLWQNFDIT
 1021 ELRLRCDVKM GGEGTVLVPR VNNARAKQLF GKKVLVSQDG VTFFERSQTG GKPHSEKQTD
 1081 LTDKELELIA EADEARAKSV VLFRDPSGHI GKGHWIRQRE FWSLVKQRIE SHTAERIRVR
 1141 GVGSSLD
```

FIG. 27C

BhiCas12b (*Bacillus hisashii* Cas12b, SEQ ID NO:573)
```
   1 MATRSFILKI EPNEEVKKGL WKTHEVLNHG IAYYMNILKL IRQEAIYEHH EQDPKNPKKV
  61 SKAEIQAELW DFVLKMQKCN SFTHEVDKDE VFNILRELYE ELVPSSVEKK GEANQLSNKF
 121 LYPLVDPNSQ SGKGTASSGR KPRWYNLKIA GDPSWEEEKK KWEEDKKKDP LAKILGKLAE
 181 YGLIPLFIPY TDSNEPIVKE IKWMEKSRNQ SVRRLDKDMF IQALERFLSW ESWNLKVKEE
 241 YEKVEKEYKT LEERIKEDIQ ALKALEQYEK ERQEQLLRDT LNTNEYRLSK RGLRGWREII
 301 QKWLKMDENE PSEKYLEVFK DYQRKHPREA GDYSVYEFLS KKENHFIWRN HPEYPYLYAT
 361 FCEIDKKKKD AKQQATFTLA DPINHPLWVR FEERSGSNLN KYRILTEQLH TEKLKKKLTV
 421 QLDRLIYPTE SGGWEEKGKV DIVLLPSRQF YNQIFLDIEE KGKHAFTYKD ESIKFPLKGT
 481 LGGARVQFDR DHLRRYPHKV ESGNVGRIYF NMTVNIEPTE SPVSKSLKIH RDDFPKVVNF
 541 KPKELTEWIK DSKGKKLKSG IESLEIGLRV MSIDLGQRQA AAASIFEVVD QKPDIEGKLF
 601 FPIKGTELYA VHRASFNIKL PGETLVKSRE VLRKAREDNL KLMNQKLNFL RNVLHFQQFE
 661 DITEREKRVT KWISRQENSD VPLVYQDELI QIRELMYKPY KDWVAFLKQL HKRLEVEIGK
 721 EVKHWRKSLS DGRKGLYGIS LKNIDEIDRT RKFLLRWSLR PTEPGEVRRL EPGQRFAIDQ
 781 LNHLNALKED RLKKMANTII MHALGYCYDV RKKKWQAKNP ACQIILFEDL SNYNPYEERS
 841 RFENSKLMKW SRREIPRQVA LQGEIYGLQV GEVGAQFSSR FHAKTGSPGI RCSVVTKEKL
 901 QDNRFFKNLQ REGRLTLDKI AVLKEGDLYP DKGGEKFISL SKDRKCVTTH ADINAAQNLQ
 961 KRFWTRTHGF YKVYCKAYQV DGQTVYIPES KDQKQKIIEE FGEGYFILKD GVYEWVNAGK
1021 LKIKKGSSKQ SSSELVDSDI LKDSFDLASE LKGEKLMLYR DPSGNVFPSD KWMAAGVFFG
1081 KLERILISKL TNQYSISTIE DDSSKQSM
```

FIG. 27D

| Portion | Sequence (e.g., for use with AacCas12b or AatCas12b) | SEQ ID NO: |
|---|---|---|
| F | GTCTAAAGGACAGAATTTTTCAACGGGTGTGCCAATGGCCACTTTCCAGGTGGCAAAG<br>CCCGTTGAACTTCCCGGGACGTCTGTACCC | 580 |
|  | AACTGTCTAAAGGACAGAATTTTTCAACGGGTGTGCCAATGGCCACTTTCCAGGTGGC<br>AAAGCCCGTTGAACTTCTCAAAAAGAACGCTCGCTCAGTGTTCTG | 581 |
|  | CTGTCTAAAGGACAGAATTTTTCAACGGGTGTGCCAATGGCCACTTTCCAGGTGGCAA<br>AGCCCGTTGAACTTCTCAAAAAGAACGCTCGCTCAGTGTTCTG | 582 |
|  | GTCTAAAGGACAGAATTTTTCAACGGGTGTGCCAATGGCCACTTTCCAGGTGGCAAAG<br>CCCGTTGAACTTCTCAAAAAGAACGCTCGCTCAGTG | 583 |
|  | GTCTAAAGGACAGAATTTTTCAACGGGTGTGCCAATGGCCACTTTCCAGGTGGCAAAG<br>CCCGTTGAACTTCTCAAAAAGA | 584 |
|  | GUCUAAAGGACAGAAUUUUUCAACGGGUGUGCCAAUGGCCACUUUCCAGGUGGCAAAG<br>CCCGUUGAACUUCUCA | 585 |
|  | GTCTAAAGGACAGAATTTTTCAACGGGTGTGCCAATGGCCACTTTCCAGGTGGCAAAG<br>CCCGTTGAACTTCTCA | 586 |
|  | GUCUAAAGGACAGAAUUUUUCAACGGGUGUGCCAAUGGCCACUUUCCAGGUGGCAAAG<br>CCCGUUGAACUUCUC | 587 |
|  | GTCTAAAGGACAGAATTTTTCAACGGGTGTGCCAATGGCCACTTTCCAGGTGGCAAAG<br>CCCGTTGAACTTCTC | 588 |
|  | GUCUAAAGGACAGAAUUUUUCAACGGGUGUGCCAAUGGCCACUUUCCAGGUGGCAAAG<br>CCCGUUGAACUUCU | 589 |
|  | GTCTAAAGGACAGAATTTTTCAACGGGTGTGCCAATGGCCACTTTCCAGGTGGCAAAG<br>CCCGTTGAACTTCT | 590 |
|  | GUCUAAAGGACAGAAUUUUUCAACGGGUGUGCCAAUGGCCACUUUCCAGGUGGCAAAG<br>CCCGUUGAACUUC | 591 |
|  | GTCTAAAGGACAGAATTTTTCAACGGGTGTGCCAATGGCCACTTTCCAGGTGGCAAAG<br>CCCGTTGAACTTC | 592 |
|  | GUCUAGAGGACAGAAUUUUUCAACGGGUGUGCCAAUGGCCACUUUCCAGGUGGCAAAG<br>CCCGUUGAGCUUCUCA | 593 |
|  | GTCTAGAGGACAGAATTTTTCAACGGGTGTGCCAATGGCCACTTTCCAGGTGGCAAAG<br>CCCGTTGAGCTTCTCA | 594 |

FIG. 28A

| Portion | Sequence (e.g., for use with AacCas12b or AatCas12b) | SEQ ID NO: |
|---|---|---|
| L | AAGC | 595 |
| | AAAC | 596 |
| | ACUA | 597 |
| | ACTA | 598 |
| | ACGU | 599 |
| | ACGT | 600 |
| | UUAU | 601 |
| | TTAT | 602 |
| | UUAC | 603 |
| | TTAC | 604 |
| | ACGA | 605 |
| | AAUC | 606 |
| | AATC | 607 |
| | AAAAGC | 608 |
| | AAAA | 609 |
| E | GAAGUGGCAC | 610 |
| | GAAGTGGCAC | 611 |
| | GGAGUACAACCGGGAAGUGGCAC | 612 |
| | GGAGTACAACCGGGAAGTGGCAC | 613 |
| | CGGAUCACUGAGCGAGCGAUCUGAGAAGUGGCAC | 614 |
| | CGGATCACTGAGCGAGCGATCTGAGAAGTGGCAC | 615 |
| | CACUGAGCGAGCGAUCUGAGAAGUGGCAC | 616 |
| | CACTGAGCGAGCGATCTGAGAAGTGGCAC | 617 |
| | UCUGAGAAGUGGCAC | 618 |
| | TCTGAGAAGTGGCAC | 619 |
| | UGAGAAGUGGCAC | 620 |
| | TGAGAAGTGGCAC | 621 |
| | GAGAAGUGGCAC | 622 |
| | GAGAAGTGGCAC | 623 |
| | AGAAGUGGCAC | 624 |
| | AGAAGTGGCAC | 625 |
| | GAAGUGGCAC | 626 |
| | GAAGTGGCAC | 627 |

FIG. 28B

| Portion | Sequence (e.g., for use with AkaCas12b) | SEQ ID NO: |
|---|---|---|
| F | GUCGUCUAUAGGACGGCGAGGACAACGGGAAGUGCCAAUGUGCUCUUUCCAAGAGCAAACACCCCGUUGGCUUCAAGAUGACCGCUCG | 628 |
| | GTCGTCTATAGGACGGCGAGGACAACGGGAAGTGCCAATGTGCTCTTTCCAAGAGCAAACACCCCGTTGGCTTCAAGATGACCGCTCG | 629 |
| | GUCGUCUAUAGGACGGCGAGGACAACGGGAAGUGCCAAUGUGCUCUUUCCAAGAGCAAACACCCCGUUGGCUUCAAGAUGACCGCUCGCUCAGCGAUCUGAC | 630 |
| | GTCGTCTATAGGACGGCGAGGACAACGGGAAGTGCCAATGTGCTCTTTCCAAGAGCAAACACCCCGTTGGCTTCAAGATGACCGCTCGCTCAGCGATCTGAC | 631 |
| | GUCGUCUAUAGGACGGCGAGGACAACGGGAAGUGCCAAUGUGCUCUUUCCAAGAGCAAACACCCCGUUGGCUUCAAGAUGACCGCUCGCUCAGCGAUCUG | 632 |
| | GTCGTCTATAGGACGGCGAGGACAACGGGAAGTGCCAATGTGCTCTTTCCAAGAGCAAACACCCCGTTGGCTTCAAGATGACCGCTCGCTCAGCGATCTG | 633 |
| L | AAAA | 634 |
| | AAAC | 635 |
| | UUAU | 636 |
| | TTAT | 637 |
| | UUAC | 638 |
| | TTAC | 639 |
| E | CGAGCGGUCUGAGAAGUGGCACU | 640 |
| | CGAGCGGTCTGAGAAGTGGCACT | 641 |
| | AACGGAUCGCUGAGCGAGCGGUCUGAGAAGUGGCAC | 642 |
| | AACGGATCGCTGAGCGAGCGGTCTGAGAAGTGGCAC | 643 |
| | CGGAUCGCUGAGCGAGCGGUCUGAGAAGUGGCAC | 644 |
| | CGGATCGCTGAGCGAGCGGTCTGAGAAGTGGCAC | 645 |

FIG. 28C

| Portion | Sequence (e.g., for use with BhiCas12b) | SEQ ID NO: |
|---|---|---|
| F | ACGAGGUUCUGUCUUUUGGUCAGGACAACCGUCUAGCUAUAAGUGCUGCAGGGUGUGAGAAACUCCUAUUGCUGGACGAUGUCUC | 646 |
| | ACGAGGTTCTGTCTTTTGGTCAGGACAACCGTCTAGCTATAAGTGCTGCAGGGTGTGAGAAACTCCTATTGCTGGACGATGTCTC | 647 |
| | GUUCUGUCUUUUGGUCAGGACAACCGUCUAGCUAUAAGUGCUGCAGGGUGUGAGAAACUCCUAUUGCUGGACGAUGUCUC | 648 |
| | GTTCTGTCTTTTGGTCAGGACAACCGTCTAGCTATAAGTGCTGCAGGGTGTGAGAAACTCCTATTGCTGGACGATGTCTC | 649 |
| | GUUCUGUCUUUUGGUCAGGACAACCGUCUAGCUAUAAGUGCUGCAGGGUGUGAGAAACUCCUAUUGCUGGACGACGCCUC | 650 |
| | GTTCTGTCTTTTGGTCAGGACAACCGTCTAGCTATAAGTGCTGCAGGGTGTGAGAAACTCCTATTGCTGGACGACGCCTC | 651 |
| | GUUCUGUCUUUUGGUCAGGACAACCGUCUAGCUAUAAGUGCUGCAGGGUGUGAGAAACUCCUAUUGCUGGACGACGCC | 652 |
| | GTTCTGTCTTTTGGTCAGGACAACCGTCTAGCTATAAGTGCTGCAGGGTGTGAGAAACTCCTATTGCTGGACGACGCC | 653 |
| | GUUCUGUCUUUUGGUCAGGACAACCGUCUAGCUAUAAGUGCUGCAGGGUGCAGAAACUCCUAUUGCUGGACGACGCC | 654 |
| | GTTCTGTCTTTTGGTCAGGACAACCGTCTAGCTATAAGTGCTGCAGGGTGCAGAAACTCCTATTGCTGGACGACGCC | 655 |
| | GUUCUGUCUUUUGGUCAGGACAACCGUCUAGCUAUAAGUGCUGCAGGGUGCAGAAACUCCUAUUGCUGGACGACGCCUCAUUUAUUUC | 656 |
| | GTTCTGTCTTTTGGTCAGGACAACCGTCTAGCTATAAGTGCTGCAGGGTGCAGAAACTCCTATTGCTGGACGACGCCTCATTTATTTC | 657 |
| L | AAAA | 658 |
| | AAAC | 659 |
| | UUAU | 660 |
| | TTAT | 661 |
| | UUAC | 662 |
| | TTAC | 663 |
| E | GAGGCAUUAGCAC | 664 |
| | GAGGCATTAGCAC | 665 |
| | GAGGCGUUAGCAC | 666 |
| | GAGGCGTTAGCAC | 667 |
| | GGCGUUAGCAC | 668 |
| | GGCGTTAGCAC | 669 |
| | GAAAUGUUACGAGGCGUUAGCAC | 670 |
| | GAAATGTTACGAGGCGTTAGCAC | 671 |

FIG. 28D

| | Exemplary synthetic guiding components, F-L-E-(V)-(D) | SEQ ID NO: |
|---|---|---|
| Aac and Aat | GTCTAAAGGACAGAATTTTTCAACGGGTGTGCCAATGGCCACTTTCCAGGTGGCAAAGCCCGTTGAACTTC-AAGC-GAAGTGGCAC-(V)-(D) | 672 |
| | GTCTAAAGGACAGAATTTTTCAACGGGTGTGCCAATGGCCACTTTCCAGGTGGCAAAGCCCGTTGAACTTCCCGGGACGTCGTACCC-ACTA-GGAGTACAACCGGGAAGTGGCAC-(V)-(D) | 673 |
| | AACTGTCTAAAGGACAGAATTTTTCAACGGGTGTGCCAATGGCCACTTTCCAGGTGGCAAAGCCCGTTGAACTTCTCAAAAAGAACGCTCGCTCAGTGTTCTG-ACGT-CGGATCACTGAGCGAGCGATCTGAGAAGTGGCAC-(V)-(D) | 674 |
| | GTCTAAAGGACAGAATTTTTCAACGGGTGTGCCAATGGCCACTTTCCAGGTGGCAAAGCCCGTTGAACTTCTCAAAAAGAACGCTCGCTCAGTG-TTAT-CACTGAGCGAGCGATCTGAGAAGTGGCAC-(V)-(D) | 675 |
| | CTGTCTAAAGGACAGAATTTTTCAACGGGTGTGCCAATGGCCACTTTCCAGGTGGCAAAGCCCGTTGAACTTCTCAAAAAGCGCTCGCTCAGTGTTCTG-ACGT-CGGATCACTGAGCGAGCGATCTGAGAAGTGGCAC-(V)-(D) | 676 |
| | GTCTAAAGGACAGAATTTTTCAACGGGTGTGCCAATGGCCACTTTCCAGGTGGCAAAGCCCGTTGAACTTTCTCAAAAAGA-ACGA-TCTGAGAAGTGGCAC-(V)-(D) | 677 |
| | GTCTAAAGGACAGAATTTTTCAACGGGTGTGCCAATGGCCACTTTCCAGGTGGCAAAGCCCGTTGAACTTCTCA-AAAAGC-TGAGAAGTGGCAC-(V)-(D) | 678 |
| | GTCTAAAGGACAGAATTTTTCAACGGGTGTGCCAATGGCCACTTTCCAGGTGGCAAAGCCCGTTGAACTTCTCA-AAGC-TGAGAAGTGGCAC-(V)-(D) | 679 |
| | GTCTAAAGGACAGAATTTTTCAACGGGTGTGCCAATGGCCACTTTCCAGGTGGCAAAGCCCGTTGAACTTCTCA-AAAC-TGAGAAGTGGCAC-(V)-(D) | 680 |
| | GTCTAAAGGACAGAATTTTTCAACGGGTGTGCCAATGGCCACTTTCCAGGTGGCAAAGCCCGTTGAACTTCTC-AAGC-GAGAAGTGGCAC-(V)-(D) | 681 |
| | GTCTAAAGGACAGAATTTTTCAACGGGTGTGCCAATGGCCACTTTCCAGGTGGCAAAGCCCGTTGAACTTCT-AAGC-AGAAGTGGCAC-(V)-(D) | 682 |
| | GTCTAAAGGACAGAATTTTTCAACGGGTGTGCCAATGGCCACTTTCCAGGTGGCAAAGCCCGTTGAACTTCT-AAGC-AGAAGTGGCAC-(V)-(D) | 683 |
| | GTCTAAAGGACAGAATTTTTCAACGGGTGTGCCAATGGCCACTTTCCAGGTGGCAAAGCCCGTTGAACTTC-AAGC-GAAGTGGCAC-(V)-(D) | 684 |
| | GTCTAGAGGACAGAATTTTTCAACGGGTGTGCCAATGGCCACTTTCCAGGTGGCAAAGCCCGTTGAGCTTCTCA-AATC-TGAGAAGTGGCAC-(V)-(D) | 685 |
| Aka | GUCGUCUAUAGGACGGCGAGGACAACGGAGGACAACGGGAAGUGCCAAUGUGCCAAUGUGCUCUUUCCAAGAGCAAACACCCGUUGGCUUCAAGAUGACCGCUCG-AAAA-CGAGCGGUCGGUCUGAGAAGUGGCACU-(V)-(D) | 686 |
| | GTCGTCTATAGGACGGCGAGGACAACGGAGGACAACGGGAAGTGCCAATGTGCCAATGTGCTCTTTCCAAGAGCAAACACCCGTTGGCTTCAAGATGACCGCTCG-AAAA-CGAGCGGTCTGAGAAGTGGCACT-(V)-(D) | 687 |
| | GTCGTCTATAGGACGGCGAGGACAACGGAGGACAACGGGAAGTGCCAATGTGCTCTTTCCAAGAGCAAACACCCGTTGGCTTCAAGATGACCGCTCG-TTAC-CGAGCGGTCTGAGAAGTGGCACT-(V)-(D) | 688 |
| | GTCGTCTATAGGACGGCGAGGACAACGGGAAGTGCCAATGTGCTCTTTCCAAGAGCAAACACCCGTTGGCTTCAAGATGACCGCTCGCTCAGGATCTGAC-TTAC-AACGGATCGCTGAGCGAGCGGTCTGAGAAGTGGCAC-(V)-(D) | 689 |
| | GTCGTCTATAGGACGGCGAGGACAACGGGAAGTGCCAATGTGCTCTTTCCAAGAGCAAACACCCGTTGGCTTCAAGATGACCGCTCGCTCAGGATCTG-AAAA-CGGATCGCTGAGCGAGCGGTCTGAGAAGTGGCAC-(V)-(D) | 690 |

FIG. 29A

| | Exemplary synthetic guiding components, F-L-E-(V)-(D) | SEQ ID NO: |
|---|---|---|
| Bhi | ACGAGGTTCTGTCTTTGGTCAGGACAACCGTCAGCTATAAGTGCTGCAGGGTGTGAGAAACTCCTATTGCTGGACGATGTCTC-TTAC-GAGGCATTAGCAC-(V)-(D) | 691 |
| | GUUCUGUCUUUGGUCAGGACAACCGUCAGGACAACCGUCAGCUAUAAGUGCUGCAGGGUGUGAGAAACUCCUAUUGCUGGACGAUGUCUC-UUAC-GAGGCAUUAGCAC-(V)-(D) | 692 |
| | GTTCTGTCTTTGGTCAGGACAACCGTCAGGACAACCGTCAGCTATAAGTGCTGCAGGGTGTGAGAAACTCCTATTGCTGGACGATGTCTC-TTAC-GAGGCATTAGCAC-(V)-(D) | 693 |
| | GUUCUGUCUUUGGUCAGGACAACCGUCAGGACAACCGUCAGCUAUAAGUGCUGCAGGGUGUGAGAAACUCCUAUUGCUGGACGACGCCUC-UUAC-GAGGCGUUAGCAC-(V)-(D) | 694 |
| | GTTCTGTCTTTGGTCAGGACAACCGTCAGGACAACCGTCAGCTATAAGTGCTGCAGGGTGTGAGAAACTCCTATTGCTGGACGACGCCTC-TTAC-GAGGCGTTAGCAC-(V)-(D) | 695 |
| | GUUCUGUCUUUGGUCAGGACAACCGUCAGGACAACCGUCAUUAAGUGCUGCAGGGUGCAGGGUGCAGAAACUCCUAUUGCUGGACGACGACGCC-UUAC-GGCGUUAGCAC-(V)-(D) | 696 |
| | GTTCTGTCTTTGGTCAGGACAACCGTCAGGACAACCGTCAGCTATAAGTGCTGCAGGGTGCAGGGTGCAGAAACTCCTATTGCTGGACGACGACGCC-TTAC-GGCGTTAGCAC-(V)-(D) | 697 |
| | GTTCTGTCTTTGGTCAGGACAACCGTCAGGACAACCGTCAGCTATAAGTGCTGCAGGGTGCAGGGTGCAGAAACTCCTATTGCTGGACGACGACGCCTCATTTATTTC-AAAA-GAAATGTTACGAGGCGTTAGCAC-(V)-(D) | 698 |
| | | 699 |

FIG. 29B

CkaCasY (*Candidatus Katanobacteria* CasY.1, SEQ ID NO:700)
```
   1 MRKKLFKGYI LHNKRLVYTG KAAIRSIKYP LVAPNKTALN NLSEKIIYDY EHLFGPLNVA
  61 SYARNSNRYS LVDFWIDSLR AGVIWQSKST SLIDLISKLE GSKSPSEKIF EQIDFELKNK
 121 LDKEQFKDII LLNTGIRSSS NVRSLRGRFL KCFKEEFRDT EEVIACVDKW SKDLIVEGKS
 181 ILVSKQFLYW EEEFGIKIFP HFKDNHDLPK LTFFVEPSLE FSPHLPLANC LERLKKFDIS
 241 RESLLGLDNN FSAFSNYFNE LFNLLSRGEI KKIVTAVLAV SKSWENEPEL EKRLHFLSEK
 301 AKLLGYPKLT SSWADYRMII GGKIKSWHSN YTEQLIKVRE DLKKHQIALD KLQEDLKKVV
 361 DSSLREQIEA QREALLPLLD TMLKEKDFSD DLELYRFILS DFKSLLNGSY QRYIQTEEER
 421 KEDRDVTKKY KDLYSNLRNI PRFFGESKKE QFNKFINKSL PTIDVGLKIL EDIRNALETV
 481 SVRKPPSITE EYVTKQLEKL SRKYKINAFN SNRFKQITEQ VLRKYNNGEL PKISEVFYRY
 541 PRESHVAIRI LPVKISNPRK DISYLLDKYQ ISPDWKNSNP GEVVDLIEIY KLTLGWLLSC
 601 NKDFSMDFSS YDLKLFPEAA SLIKNFGSCL SGYYLSKMIF NCITSEIKGM ITLYTRDKFV
 661 VRYVTQMIGS NQKFPLLCLV GEKQTKNFSR NWGVLIEEKG DLGEEKNQEK CLIFKDKTDF
 721 AKAKEVEIFK NNIWRIRTSK YQIQFLNRLF KKTKEWDLMN LVLSEPSLVL EEEWGVSWDK
 781 DKLLPLLKKE KSCEERLYYS LPLNLVPATD YKEQSAEIEQ RNTYLGLDVG EFGVAYAVVR
 841 IVRDRIELLS WGFLKDPALR KIRERVQDMK KKQVMAVFSS SSTAVARVRE MAIHSLRNQI
 901 HSIALAYKAK IIYEISISNF ETGGNRMAKI YRSIKVSDVY RESGADTLVS EMIWGKKNKQ
 961 MGNHISSYAT SYTCCNCART PFELVIDNDK EYEKGGDEFI FNVGDEKKVR GFLQKSLLGK
1021 TIKGKEVLKS IKEYARPPIR EVLLEGEDVE QLLKRRGNSY IYRCPFCGYK TDADIQAALN
1081 IACRGYISDN AKDAVKEGER KLDYILEVRK LWEKNGAVLR SAKFL
```

FIG. 30A

CvolCasY (*Candidatus Vogelbacteria* CasY.2, SEQ ID NO:701)
```
   1 MQKVRKTLSE VHKNPYGTKV RNAKTGYSLQ IERLSYTGKE GMRSFKIPLE NKNKEVFDEF
  61 VKKIRNDYIS QVGLLNLSDW YEHYQEKQEH YSLADFWLDS LRAGVIFAHK ETEIKNLISK
 121 IRGDKSIVDK FNASIKKKHA DLYALVDIKA LYDFLTSDAR RGLKTEEEFF NSKRNTLFPK
 181 FRKKDNKAVD LWVKKFIGLD NKDKLNFTKK FIGFDPNPQI KYDHTFFFHQ DINFDLERIT
 241 TPKELISTYK KFLGKNKDLY GSDETTEDQL KMVLGFHNNH GAFSKYFNAS LEAFRGRDNS
 301 LVEQIINNSP YWNSHRKELE KRIIFLQVQS KKIKETELGK PHEYLASFGG KFESWVSNYL
 361 RQEEEVKRQL FGYEENKKGQ KKFIVGNKQE LDKIIRGTDE YEIKAISKET IGLTQKCLKL
 421 LEQLKDSVDD YTLSLYRQLI VELRIRLNVE FQETYPELIG KSEKDKEKDA KNKRADKRYP
 481 QIFKDIKLIP NFLGETKQMV YKKFIRSADI LYEGINFIDQ IDKQITQNLL PCFKNDKERI
 541 EFTEKQFETL RRKYYLMNSS RFHHVIEGII NNRKLIEMKK RENSELKTFS DSKFVLSKLF
 601 LKKGKKYENE VYYTFYINPK ARDQRRIKIV LDINGNNSVG ILQDLVQKLK PKWDDIIKKN
 661 DMGELIDAIE IEKVRLGILI ALYCEHKFKI KKELLSLDLF ASAYQYLELE DDPEELSGTN
 721 LGRFLQSLVC SEIKGAINKI SRTEYIERYT VQPMNTEKNY PLLINKEGKA TWHIAAKDDL
 781 SKKKGGGTVA MNQKIGKNFF GKQDYKTVFM LQDKRFDLLT SKYHLQFLSK TLDTGGGSWW
 841 KNKNIDLNLS SYSFIFEQKV KVEWDLTNLD HPIKIKPSEN SDDRRLFVSI PFVIKPKQTK
 901 RKDLQTRVNY MGIDIGEYGL AWTIINIDLK NKKINKISKQ GFIYEPLTHK VRDYVATIKD
 961 NQVRGTFGMP DTKLARLREN AITSLRNQVH DIAMRYDAKP VYEFEISNFE TGSNKVKVIY
1021 DSVKRADIGR GQNNTEADNT EVNLVWGKTS KQFGSQIGAY ATSYICSFCG YSPYYEFENS
1081 KSGDEEGARD NLYQMKKLSR PSLEDFLQGN PVYKTFRDFD KYKNDQRLQK TGDKDGEWKT
1141 HRGNTAIYAC QKCRHISDAD IQASYWIALK QVVRDFYKDK EMDGDLIQGD NKDKRKVNEL
1201 NRLIGVHKDV PIINKNLITS LDINLL
```

FIG. 30B

```
Cvo2CasY (Candidatus Vogelbacteria CasY.3, SEQ ID NO:702)
   1 MKAKKSFYNQ KRKFGKRGYR LHDERIAYSG GIGSMRSIKY ELKDSYGIAG LRNRIADATI
  61 SDNKWLYGNI NLNDYLEWRS SKTDKQIEDG DRESSLLGFW LEALRLGFVF SKQSHAPNDF
 121 NETALQDLFE TLDDDLKHVL DRKKWCDFIK IGTPKTNDQG RLKKQIKNLL KGNKREEIEK
 181 TLNESDDELK EKINRIADVF AKNKSDKYTI FKLDKPNTEK YPRINDVQVA FFCHPDFEEI
 241 TERDRTKTLD LIINRFNKRY EITENKKDDK TSNRMALYSL NQGYIPRVLN DLFLFVKDNE
 301 DDFSQFLSDL ENFFSFSNEQ IKIIKERLKK LKKYAEPIPG KPQLADKWDD YASDFGGKLE
 361 SWYSNRIEKL KKIPESVSDL RNNLEKIRNV LKKQNNASKI LELSQKIIEY IRDYGVSFEK
 421 PEIIKFSWIN KTKDGQKKVF YVAKMADREF IEKLDLWMAD LRSQLNEYNQ DNKVSFKKKG
 481 KKIEELGVLD FALNKAKKNK STKNENGWQQ KLSESIQSAP LFFGEGNRVR NEEVYNLKDL
 541 LFSEIKNVEN ILMSSEAEDL KNIKIEYKED GAKKGNYVLN VLARFYARFN EDGYGGWNKV
 601 KTVLENIARE AGTDFSKYGN NNNRNAGRFY LNGRERQVFT LIKFEKSITV EKILELVKLP
 661 SLLDEAYRDL VNENKNHKLR DVIQLSKTIM ALVLSHSDKE KQIGGNYIHS KLSGYNALIS
 721 KRDFISRYSV QTTNGTQCKL AIGKGKSKKG NEIDRYFYAF QFFKNDDSKI NLKVIKNNSH
 781 KNIDFNDNEN KINALQVYSS NYQIQFLDWF FEKHQGKKTS LEVGGSFTIA EKSLTIDWSG
 841 SNPRVGFKRS DTEEKRVFVS QPFTLIPDDE DKERRKERMI KTKNRFIGID IGEYGLAWSL
 901 IEVDNGDKNN RGIRQLESGF ITDNQQQVLK KNVKSWRQNQ IRQTFTSPDT KIARLRESLI
 961 GSYKNQLESL MVAKKANLSF EYEVSGFEVG GKRVAKIYDS IKRGSVRKKD NNSQNDQSWG
1021 KKGINEWSFE TTAAGTSQFC THCKRWSSLA IVDIEEYELK DYNDNLFKVK INDGEVRLLG
1081 KKGWRSGEKI KGKELFGPVK DAMRPNVDGL GMKIVKRKYL KLDLRDWVSR YGNMAIFICP
1141 YVDCHHISHA DKQAAFNIAV
```

FIG. 30C

```
CpaCasY (Candidatus Parcubacteria CasY.4, SEQ ID NO:703)
   1 MSKRHPRISG VKGYRLHAQR LEYTGKSGAM RTIKYPLYSS PSGGRTVPRE IVSAINDDYV
  61 GLYGLSNFDD LYNAEKRNEE KVYSVLDFWY DCVQYGAVFS YTAPGLLKNV AEVRGGSYEL
 121 TKTLKGSHLY DELQIDKVIK FLNKKEISRA NGSLDKLKKD IIDCFKAEYR ERHKDQCNKL
 181 ADDIKNAKKD AGASLGERQK KLFRDFFGIS EQSENDKPSF TNPLNLTCCL LPFDTVNNNR
 241 NRGEVLFNKL KEYAQKLDKN EGSLEMWEYI GIGNSGTAFS NFLGEGFLGR LRENKITELK
 301 KAMMDITDAW RGQEQEEELE KRLRILAALT IKLREPKFDN HWGGYRSDIN GKLSSWLQNY
 361 INQTVKIKED LKGHKKDLKK AKEMINRFGE SDTKEEAVVS SLLESIEKIV PDDSADDEKP
 421 DIPAIAIYRR FLSDGRLTLN RFVQREDVQE ALIKERLEAE KKKKPKKRKK KSDAEDEKET
 481 IDFKELFPHL AKPLKLVPNF YGDSKRELYK KYKNAAIYTD ALWKAVEKIY KSAFSSSLKN
 541 SFFDTDFDKD FFIKRLQKIF SVYRRFNTDK WKPIVKNSFA PYCDIVSLAE NEVLYKPKQS
 601 RSRKSAAIDK NRVRLPSTEN IAKAGIALAR ELSVAGFDWK DLLKKEEHEE YIDLIELHKT
 661 ALALLLAVTE TQLDISALDF VENGTVKDFM KTRDGNLVLE GRFLEMFSQS IVFSELRGLA
 721 GLMSRKEFIT RSAIQTMNGK QAELLYIPHE FQSAKITTPK EMSRAFLDLA PAEFATSLEP
 781 ESLSEKSLLK LKQMRYYPHY FGYELTRTGQ GIDGGVAENA LRLEKSPVKK REIKCKQYKT
 841 LGRGQNKIVL YVRSSYYQTQ FLEWFLHRPK NVQTDVAVSG SFLIDEKKVK TRWNYDALTV
 901 ALEPVSGSER VFVSQPFTIF PEKSAEEEGQ RYLGIDIGEY GIAYTALEIT GDSAKILDQN
 961 FISDPQLKTL REEVKGLKLD QRRGTFAMPS TKIARIRESL VHSLRNRIHH LALKHKAKIV
1021 YELEVSRFEE GKQKIKKVYA TLKKADVYSE IDADKNLQTT VWGKLAVASE ISASYTSQFC
1081 GACKKLWRAE MQVDETITTQ ELIGTVRVIK GGTLIDAIKD FMRPPIFDEN DTPFPKYRDF
1141 CDKHHISKKM RGNSCLFICP FCRANADADI QASQTIALLR YVKEEKKVED YFERFRKLKN
1201 IKVLGQMKKI
```

FIG. 30D

CkoCasY (Candidatus Komeilibacteria CasY.5, SEQ ID NO:704)
```
   1 MAESKQMQCR KCGASMKYEV IGLGKKSCRY MCPDCGNHTS ARKIQNKKKR DKKYGSASKA
  61 QSQRIAVAGA LYPDKKVQTI KTYKYPADLN GEVHDSGVAE KIAQAIQEDE IGLLGPSSEY
 121 ACWIASQKQS EPYSVVDFWF DAVCAGGVFA YSGARLLSTV LQLSGEESVL RAALASSPFV
 181 DDINLAQAEK FLAVSRRTGQ DKLGKRIGEC FAEGRLEALG IKDRMREFVQ AIDVAQTAGQ
 241 RFAAKLKIFG ISQMPEAKQW NNDSGLTVCI LPDYYVPEEN RADQLVVLLR RLREIAYCMG
 301 IEDEAGFEHL GIDPGALSNF SNGNPKRGFL GRLLNNDIIA LANNMSAMTP YWEGRKGELI
 361 ERLAWLKHRA EGLYLKEPHF GNSWADHRSR IFSRIAGWLS GCAGKLKIAK DQISGVRTDL
 421 FLLKRLLDAV PQSAPSPDFI ASISALDRFL EAAESSQDPA EQVRALYAFH LNAPAVRSIA
 481 NKAVQRSDSQ EWLIKELDAV DHLEFNKAFP FFSDTGKKKK KGANSNGAPS EEEYTETESI
 541 QQPEDAEQEV NGQEGNGASK NQKKFQRIPR FFGEGSRSEY RILTEAPQYF DMFCNNMRAI
 601 FMQLESQPRK APRDFKCFLQ NRLQKLYKQT FLNARSNKCR ALLESVLISW GEFYTYGANE
 661 KKFRLRHEAS ERSSDPDYVV QQALEIARRL FLFGFEWRDC SAGERVDLVE IHKKAISFLL
 721 AITQAEVSVG SYNWLGNSTV SRYLSVAGTD TLYGTQLEEF LNATVLSQMR GLAIRLSSQE
 781 LKDGFDVQLE SSCQDNLQHL LVYRASRDLA ACKRATCPAE LDPKILVLPV GAFIASVMKM
 841 IERGDEPLAG AYLRHRPHSF GWQIRVRGVA EVGMDQGTAL AFQKPTESEP FKIKPFSAQY
 901 GPVLWLNSSS YSQSQYLDGF LSQPKNWSMR VLPQAGSVRV EQRVALIWNL QAGKMRLERS
 961 GARAFFMPVP FSFRPSGSGD EAVLAPNRYL GLFPHSGGIE YAVVDVLDSA GFKILERGTI
1021 AVNGFSQKRG ERQEEAHREK QRRGISDIGR KKPVQAEVDA ANELHRKYTD VATRLGCRIV
1081 VQWAPQPKPG TAPTAQTVYA RAVRTEAPRS GNQEDHARMK SSWGYTWGTY WEKRKPEDIL
1141 GISTQVYWTG GIGESCPAVA VALLGHIRAT STQTEWEKEE VVFGRLKKFF PS
```
FIG. 30E Cke1CasY (Candidatus Kerfeldbacteria CasY.6, SEQ ID NO:705)
```
   1 MAESKQMQCR KCGASMKYEV IGLGKKSCRY MCPDCGNHTS ARKIQNKKKR DKKYGSASKA
  61 QSQRIAVAGA LYPDKKVQTI KTYKYPADLN GEVHDRGVAE KIEQAIQEDE IGLLGPSSEY
 121 ACWIASQKQS EPYSVVDFWF DAVCAGGVFA YSGARLLSTV LQLSGEESVL RAALASSPFV
 181 DDINLAQAEK FLAVSRRTGQ DKLGKRIGEC FAEGRLEALG IKDRMREFVQ AIDVAQTAGQ
 241 RFAAKLKIFG ISQMPEAKQW NNDSGLTVCI LPDYYVPEEN RADQLVVLLR RLREIAYCMG
 301 IEDEAGFEHL GIDPGALSNF SNGNPKRGFL GRLLNNDIIA LANNMSAMTP YWEGRKGELI
 361 ERLAWLKHRA EGLYLKEPHF GNSWADHRSR IFSRIAGWLS GCAGKLKIAK DQISGVRTDL
 421 FLLKRLLDAV PQSAPSPDFI ASISALDRFL EAAESSQDPA EQVRALYAFH LNAPAVRSIA
 481 NKAVQRSDSQ EWLIKELDAV DHLEFNKAFP FFSDTGKKKK KGANSNGAPS EEEYTETESI
 541 QQPEDAEQEV NGQEGNGASK NQKKFQRIPR FFGEGSRSEY RILTEAPQYF DMFCNNMRAI
 601 FMQLESQPRK APRDFKCFLQ NRLQKLYKQT FLNARSNKCR ALLESVLISW GEFYTYGANE
 661 KKFRLRHEAS ERSSDPDYVV QQALEIARRL FLFGFEWRDC SAGERVDLVE IHKKAISFLL
 721 AITQAEVSVG SYNWLGNSTV SRYLSVAGTD TLYGTQLEEF LNATVLSQMR GLAIRLSSQE
 781 LKDGFDVQLE SSCQDNLQHL LVYRASRDLA ACKRATCPAE LDPKILVLPA GAFIASVMKM
 841 IERGDEPLAG AYLRHRPHSF GWQIRVRGVA EVGMDQGTAL AFQKPTESEP FKIKPFSAQY
 901 GPVLWLNSSS YSQSQYLDGF LSQPKNWSMR VLPQAGSVRV EQRVALIWNL QAGKMRLERS
 961 GARAFFMPVP FSFRPSGSGD EAVLAPNRYL GLFPHSGGIE YAVVDVLDSA GFKILERGTI
1021 AVNGFSQKRG ERQEEAHREK QRRGISDIGR KKPVQAEVDA ANELHRKYTD VATRLGCRIV
1081 VQWAPQPKPG TAPTAQTVYA RAVRTEAPRS GNQEDHARMK SSWGYTWSTY WEKRKPEDIL
1141 GISTQVYWTG GIGESCPAVA VALLGHIRAT STQTEWEKEE VVFGRLKKFF PS
```
FIG. 30F

```
Cke2CasY (Candidatus Kerfeldbacteria CasY.7, SEQ ID NO:706)
   1 MKRILNSLKV AALRLLFRGK GSELVKTVKY PLVSPVQGAV EELAEAIRHD NLHLFGQKEI
  61 VDLMEKDEGT QVYSVVDFWL DTLRLGMFFS PSANALKITL GKFNSDQVSP FRKVLEQSPF
 121 FLAGRLKVEP AERILSVEIR KIGKRENRVE NYAADVETCF IGQLSSDEKQ SIQKLANDIW
 181 DSKDHEEQRM LKADFFAIPL IKDPKAVTEE DPENETAGKQ KPLELCVCLV PELYTRGFGS
 241 IADFLVQRLT LLRDKMSTDT AEDCLEYVGI EEEKGNGMNS LLGTFLKNLQ GDGFEQIFQF
 301 MLGSYVGWQG KEDVLRERLD LLAEKVKRLP KPKFAGEWSG HRMFLHGQLK SWSSNFFRLF
 361 NETRELLESI KSDIQHATML ISYVEEKGGY HPQLLSQYRK LMEQLPALRT KVLDPEIEMT
 421 HMSEAVRSYI MIHKSVAGFL PDLLESLDRD KDREFLLSIF PRIPKIDKKT KEIVAWELPG
 481 EPEEGYLFTA NNLFRNFLEN PKHVPRFMAE RIPEDWTRLR SAPVWFDGMV KQWQKVVNQL
 541 VESPGALYQF NESFLRQRLQ AMLTVYKRDL QTEKFLKLLA DVCRPLVDFF GLGGNDIIFK
 601 SCQDPRKQWQ TVIPLSVPAD VYTACEGLAI RLRETLGFEW KNLKGHERED FLRLHQLLGN
 661 LLFWIRDAKL VVKLEDWMNN PCVQEYVEAR KAIDLPLEIF GFEVPIFLNG YLFSELRQLE
 721 LLLRRKSVMT SYSVKTTGSP NRLFQLVYLP LNPSDPEKKN SNNFQERLDT PTGLSRRFLD
 781 LTLDAFAGKL LTDPVTQELK TMAGFYDHLF GFKLPCKLAA MSNHPGSSSK MVVLAKPKKG
 841 VASNIGFEPI PDPAHPVFRV RSSWPELKYL EGLLYLPEDT PLTIELAETS VSCQSVSSVA
 901 FDLKNLTTIL GRVGEFRVTA DQPFKLTPII PEKEESFIGK TYLGLDAGER SGVGFAIVTV
 961 DGDGYEVQRL GVHEDTQLMA LQQVASKSLK EPVFQPLRKG TFRQQERIRK SLRGCYWNFY
1021 HALMIKYRAK VVHEESVGSS GLVGQWLRAF QKDLKKADVL PKKGGKNGVD KKKRESSAQD
1081 TLWGGAFSKK EEQQIAFEVQ AAGSSQFCLK CGWWFQLGMR EVNRVQESGV VLDWNRSIVT
1141 FLIESSGEKV YGFSPQQLEK GFRPDIETFK KMVRDFMRPP MFDRKGRPAA AYERFVLGRR
1201 HRRYRFDKVF EERFGRSALF ICPRVGCGNF DHSSEQSAVV LALIGYIADK EGMSGKKLVY
1261 VRLAELMAEW KLKKLERSRV EEQSSAQ
```

FIG. 30G

```
UnkCasY (CasY.18, SEQ ID NO:707)
   1 MKRIAKFRHD KPVKREAWSK GYRVHKNRII NKVTRSIKYP LVVKDEWKKR LIDDAAHDYR
  61 WLVGPINYSD WCRDPNQYSI LEFWIDFLCV GGVFQSSHSN ICRLAIQLSG GSVFEQEWKD
 121 LSPFVRANLI QGIKPAEFIG FLTAEFRSSS NPKNFISKFF EGSNEDLESL TNEFASIVDF
 181 IKAKDISLLR KSLPSCKKIA PNLWEKAVGS HSTNELLKLL TKYTRVMLVA EPSHSDRVFS
 241 QTVLQSNDQD DPELTGPLPS HKVGKASYLF IPEFIREVNL DKISKLDLSA KSKLAVEQVK
 301 KLSELTSDFK QIENQSEAYF GLSTSFNELS NFLGILIRTL RNAPEAILKD QIALCAPLDK
 361 DILKITLDWL CDRAQALPEN PRFETNWAEY RSYLGGKIKS WFSNYENFFE IPQAASSQQN
 421 NNREKKLGNR SAIRALNLKK EAFEKARETF KGDKGTLEKI DLAYRLLGSI SPEVLQCDEG
 481 LKLYQQFNDE LLVLNETINQ KFQDAKRDIK AKKEKESFEK LQRNLSSPLP RIPEFFGERA
 541 KKGYQKARVS PKLARHLLEC LNDWLARFAK VEESAFSEKE FQRILDWLRT SDFLPVFIRK
 601 SKDPPSWLRY IARVATGKYY FWVSEYSRKR VQIIDKPIAQ NPLKELISWF LLNKDAFSRD
 661 NELFKGLSSK MVTLARIMAG ILRDRGEGLK ELQAMTSKLD NIGLLHPSFS VPVTDSLKDA
 721 AFYRAFFSEL EGLLNIGRSR LIIERITQLS QQSKNKKTRR PLMPEPFINE DKEVFLAFPK
 781 FETKNKVKGT RVVYNSPDEV NWLLSPIRSS KGQLSFMFRC LSEDAKIMTT SGGCSYIVEF
 841 KKLLEAQEEV LSIHDCDIIP RAFVSIPFTL ERESEETKPD WKPNRFMGVD IGEYAVAYCV
 901 IEKGTDSIEI LDCGIVRNGA HRVLKEKVDR LKRRQRSMTF GAMDTSIAAA RESLVGNYRN
 961 RLHAIALKHG AKLVYEYEVS AFESGGNRIK KVYETLKKSD CTGETEADKN ARKHIWGETN
1021 AVGDQIGAGW TSQTCAKCGR SFGADLKAGN FGVAVPVPEK VEDSKGHYAY HEFPFEDGLK
1081 VRGFLKPNKI ISDQKELAKA VHAYMRPPLV ALGKRKLPKN ARYRRGNSSL FRCPFSDCGF
1141 TADADIQAAY NIAVKQLYKP KKGYPKERKW QDFVILKPKE PSKLFDKQFY RPN
```

FIG. 30H

| Portion | Sequence (e.g., for use with CkaCasY) | SEQ ID NO: |
| --- | --- | --- |
| F | CUCCGA | 710 |
| | CTCCGA | 711 |
| | CCCCGA | 712 |
| L | AAGUA | 713 |
| | AAGTA | 714 |
| | AAAAA | 715 |
| E | UCGGGGAUAAAGGC | 716 |
| | TCGGGGATAAAGGC | 717 |
| | UCGGAGAUAAAGGC | 718 |
| | TCGGAGATAAAGGC | 719 |
| | CUCCGAAAGUAUCGGGGAUAAAGGC | 720 |
| | CTCCGAAAGTATCGGGGATAAAGGC | 721 |

FIG. 31A

| Portion | Sequence (e.g., for use with Cvo1CasY) | SEQ ID NO: |
| --- | --- | --- |
| F | CACCGAAAUUU | 722 |
| | CACCGAAATTT | 723 |
| | CACCGAAAUCC | 724 |
| | CACCGAAATCC | 725 |
| L | GGAGA | 726 |
| | GAAGA | 727 |
| | AAAAA | 728 |
| E | GGAUAAGGC | 729 |
| | GGATAAGGC | 730 |
| | AAAUAAGGC | 731 |
| | AAATAAGGC | 732 |
| | CACCGAAAUUUGGAGAGGAUAAGGC | 733 |
| | CACCGAAATTTGGAGAGGATAAGGC | 734 |

FIG. 31B

| Portion | Sequence (e.g., for use with Cvo2CasY) | SEQ ID NO: |
| --- | --- | --- |
| F | CUCCGA | 735 |
| | CTCCGA | 736 |
| L | AUUA | 737 |
| | ATTA | 738 |
| | AAAA | 739 |
| E | UCGGGAGGAUAAGGC | 740 |
| | TCGGGAGGATAAGGC | 741 |
| | UCGGAGGAUAAGGC | 742 |
| | TCGGAGGATAAGGC | 743 |
| | CUCCGAAUUAUCGGGAGGAUAAGGC | 744 |
| | CTCCGAATTATCGGGAGGATAAGGC | 745 |

FIG. 31C

| Portion | Sequence (e.g., for use with CpaCasY) | SEQ ID NO: |
|---|---|---|
| F | CCCC | 746 |
|  | CUCC | 747 |
|  | CTCC | 748 |
| L | GAAUAUA | 749 |
|  | GAATATA | 750 |
|  | AAAAA | 751 |
|  | AAAA | 752 |
| E | GGGGACAAAAAGGC | 753 |
|  | GAGGACAAAAAGGC | 754 |
|  | CCCCGAAUAUAGGGGACAAAAAGGC | 755 |
|  | CCCCGAATATAGGGGACAAAAAGGC | 756 |

FIG. 31D

| Portion | Sequence (e.g., for use with CkoCasY) | SEQ ID NO: |
|---|---|---|
| F | GUCUAGACAUACA | 757 |
|  | GTCTAGACATACA | 758 |
|  | GUCUAGACAUUCA | 759 |
|  | GTCTAGACATTCA | 760 |
| L | GGTGGAAAGG | 761 |
|  | GGUGGAAAGG | 762 |
|  | AAAAA | 763 |
|  | AAAA | 764 |
| E | UGAGAGUAAAGAC | 765 |
|  | TGAGAGTAAAGAC | 766 |
|  | UGUGAGUAAAGAC | 767 |
|  | TGTGAGTAAAGAC | 768 |
|  | GUCUAGACAUACAGGUGGAAAGGUGAGAGUAAAGAC | 769 |
|  | GTCTAGACATACAGGTGGAAAGGTGAGAGTAAAGAC | 770 |

FIG. 31E

| Portion | Sequence (e.g., for use with Cke1CasY) | SEQ ID NO: |
|---|---|---|
| F | GUCUAGACAUAC | 771 |
|  | GTCTAGACATAC | 772 |
|  | GUCUAGACAUUC | 773 |
|  | GTCTAGACATTC | 774 |
| L | AGGTGG | 775 |
|  | AGGUGG | 776 |
|  | AAAAA | 777 |
|  | AAAA | 778 |
| E | GAAAGGUGAGAGUAAAGAC | 779 |
|  | GAAAGGTGAGAGTAAAGAC | 780 |
|  | GAACGUGAGAGUAAAGAC | 781 |
|  | GAACGTGAGAGTAAAGAC | 782 |
|  | GUCUAGACAUACAGGUGGAAAGGUGAGAGUAAAGAC | 783 |
|  | GTCTAGACATACAGGTGGAAAGGTGAGAGTAAAGAC | 784 |

FIG. 31F

| Portion | Sequence (e.g., for use with UnkCasY) | SEQ ID NO: |
|---|---|---|
| F | CUCCGUG | 785 |
| | CTCCGTG | 786 |
| | CCCCGUG | 787 |
| | CCCCGTG | 788 |
| | CUCCAUG | 789 |
| | CUCCATG | 790 |
| L | AAUA | 791 |
| | AATA | 792 |
| | AAAA | 793 |
| | AAAAA | 794 |
| E | CGUGGGGUAAAGGC | 795 |
| | CGTGGGGTAAAGGC | 796 |
| | CAUGGGGUAAAGGC | 797 |
| | CATGGGGTAAAGGC | 798 |
| | CUCCGUGAAUACGUGGGGUAAAGGC | 799 |
| | CTCCGTGAATACGTGGGGTAAAGGC | 800 |

FIG. 31G

| | Exemplary synthetic guiding components, F-L-E-(V)-(D) or E-(V)-(D) | SEQ ID NO: |
|---|---|---|
| Cka | CUCCGA-AAGUA-UCGGGGAUAAAGGC-(V)-(D) | 801 |
| | CTCCGA-AAGTA-TCGGGGATAAAGGC-(V)-(D) | 802 |
| Cvo1 | CACCGAAAUUU-GGAGA-GGAUAAGGC-(V)-(D) | 803 |
| | CACCGAAATTT-GGAGA-GGATAAGGC-(V)-(D) | 804 |
| Cvo2 | CUCCGA-AUUA-UCGGGAGGAUAAGGC-(V)-(D) | 805 |
| | CTCCGA-ATTA-TCGGGAGGATAAGGC-(V)-(D) | 806 |
| Cpa | CCCC-GAAUAUA-GGGGACAAAAAGGC-(V)-(D) | 807 |
| | CCCC-GAATATA-GGGGACAAAAAGGC-(V)-(D) | 808 |
| Cko | GUCUAGACAUACA-GGUGGAAAGG-UGAGAGUAAAGAC-(V)-(D) | 809 |
| | GTCTAGACATACA-GGTGGAAAGG-TGAGAGTAAAGAC-(V)-(D) | 810 |
| Cke1 | GUCUAGACAUAC-AGGUG-GAAAGGUGAGAGUAAAGAC-(V)-(D) | 811 |
| | GTCTAGACATAC-AGGTG-GAAAGGTGAGAGTAAAGAC-(V)-(D) | 812 |
| Unk | CUCCGUG-AAUA-CGUGGGGUAAAGGC-(V)-(D) | 813 |
| | CTCCGTG-AATA-CGTGGGGTAAAGGC-(V)-(D) | 814 |

FIG. 32

```
DpbCasX (Deltaproteobacteria CasX, SEQ ID NO:820)
    1 MEKRINKIRK KLSADNATKP VSRSGPMKTL LVRVMTDDLK KRLEKRRKKP EVMPQVISNN
   61 AANNLRMLLD DYTKMKEAIL QVYWQEFKDD HVGLMCKFAQ PASKKIDQNK LKPEMDEKGN
  121 LTTAGFACSQ CGQPLFVYKL EQVSEKGKAY TNYFGRCNVA EHEKLILLAQ LKPEKDSDEA
  181 VTYSLGKFGQ RALDFYSIHV TKESTHPVKP LAQIAGNRYA SGPVGKALSD ACMGTIASFL
  241 SKYQDIIIEH QKVVKGNQKR LESLRELAGK ENLEYPSVTL PPQPHTKEGV DAYNEVIARV
  301 RMWVNLNLWQ KLKLSRDDAK PLLRLKGFPS FPVVERRENE VDWWNTINEV KKLIDAKRDM
  361 GRVFWSGVTA EKRNTILEGY NYLPNENDHK KREGSLENPK KPAKRQFGDL LLYLEKKYAG
  421 DWGKVFDEAW ERIDKKIAGL TSHIEREEAR NAEDAQSKAV LTDWLRAKAS FVLERLKEMD
  481 EKEFYACEIQ LQKWYGDLRG NPFAVEAENR VVDISGFSIG SDGHSIQYRN LLAWKYLENG
  541 KREFYLLMNY GKKGRIRFTD GTDIKKSGKW QGLLYGGGKA KVIDLTFDPD DEQLIILPLA
  601 FGTRQGREFI WNDLLSLETG LIKLANGRVI EKTIYNKKIG RDEPALFVAL TFERREVVDP
  661 SNIKPVNLIG VDRGENIPAV IALTDPEGCP LPEFKDSSGG PTDILRIGEG YKEKQRAIQA
  721 AKEVEQRRAG GYSRKFASKS RNLADDMVRN SARDLFYHAV THDAVLVFEN LSRGFGRQGK
  781 RTFMTERQYT KMEDWLTAKL AYEGLTSKTY LSKTLAQYTS KTCSNCGFTI TTADYDGMLV
  841 RLKKTSDGWA TTLNNKELKA EGQITYYNRY KRQTVEKELS AELDRLSEES GNNDISKWTK
  901 GRRDEALFLL KKRFSHRPVQ EQFVCLDCGH EVHADEQAAL NIARSWLFLN SNSTEFKSYK
  961 SGKQPFVGAW QAFYKRRLKE VWKPNA
```

FIG. 33A

```
PlaCasX (Planctomycetes CasX, SEQ ID NO:821)
    1 MQEIKRINKI RRRLVKDSNT KKAGKTGPMK TLLVRVMTPD LRERLENLRK KPENIPQPIS
   61 NTSRANLNKL LTDYTEMKKA ILHVYWEEFQ KDPVGLMSRV AQPAPKNIDQ RKLIPVKDGN
  121 ERLTSSGFAC SQCCQPLYVY KLEQVNDKGK PHTNYFGRCN VSEHERLILL SPHKPEANDE
  181 LVTYSLGKFG QRALDFYSIH VTRESNHPVK PLEQIGGNSC ASGPVGKALS DACMGAVASF
  241 LTKYQDIILE HQKVIKKNEK RLANLKDIAS ANGLAFPKIT LPPQPHTKEG IEAYNNVVAQ
  301 IVIWVNLNLW QKLKIGRDEA KPLQRLKGFP SFPLVERQAN EVDWWDMVCN VKKLINEKKE
  361 DGKVFWQNLA GYKRQEALLP YLSSEEDRKK GKKFARYQFG DLLLHLEKKH GEDWGKVYDE
  421 AWERIDKKVE GLSKHIKLEE ERRSEDAQSK AALTDWLRAK ASFVIEGLKE ADKDEFCRCE
  481 LKLQKWYGDL RGKPFAIEAE NSILDISGFS KQYNCAFIWQ KDGVKKLNLY LIINYFKGGK
  541 LRFKKIKPEA FEANRFYTVI NKKSGEIVPM EVNFNFDDPN LIILPLAFGK RQGREFIWND
  601 LLSLETGSLK LANGRVIEKT LYNRRTRQDE PALFVALTFE RREVLDSSNI KPMNLIGIDR
  661 GENIPAVIAL TDPEGCPLSR FKDSLGNPTH ILRIGESYKE KQRTIQAAKE VEQRRAGGYS
  721 RKYASKAKNL ADDMVRNTAR DLLYYAVTQD AMLIFENLSR GFGRQGKRTF MAERQYTRME
  781 DWLTAKLAYE GLPSKTYLSK TLAQYTSKTC SNCGFTITSA DYDRVLEKLK KTATGWMTTI
  841 NGKELKVEGQ ITYYNRYKRQ NVVKDLSVEL DRLSEESVNN DISSWTKGRS GEALSLLKKR
  901 FSHRPVQEKF VCLNCGFETH ADEQAALNIA RSWLFLRSQE YKKYQTNKTT GNTDKRAFVE
  961 TWQSFYRKKL KEVWKPAV
```

FIG. 33B

CanCasX (*Candidatus Sungbacteria* CasX, SEQ ID NO:822)
```
  1 MDNANKPSTK SLVNTTRISD HFGVTPGQVT RVFSFGIIPT KRQYAIIERW FAAVEAARER
 61 LYGMLYAHFQ ENPPAYLKEK FSYETFFKGR PVLNGLRDID PTIMTSAVFT ALRHKAEGAM
121 AAFHTNHRRL FEEARKKMRE YAECLKANEA LLRGAADIDW DKIVNALRTR LNTCLAPEYD
181 AVIADFGALC AFRALIAETN ALKGAYNHAL NQMLPALVKV DEPEEAEESP RLRFFNGRIN
241 DLPKFPVAER ETPPDTETII RQLEDMARVI PDTAEILGYI HRIRHKAARR KPGSAVPLPQ
301 RVALYCAIRM ERNPEEDPST VAGHFLGEID RVCEKRRQGL VRTPFDSQIR ARYMDIISFR
361 ATLAHPDRWT EIQFLRSNAA SRRVRAETIS APFEGFSWTS NRTNPAPQYG MALAKDANAP
421 ADAPELCICL SPSSAAFSVR EKGGDLIYMR PTGGRRGKDN PGKEITWVPG SFDEYPASGV
481 ALKLRLYFGR SQARRMLTNK TWGLLSDNPR VFAANAELVG KKRNPQDRWK LFFHMVISGP
541 PPVEYLDFSS DVRSRARTVI GINRGEVNPL AYAVVSVEDG QVLEEGLLGK KEYIDQLIET
601 RRRISEYQSR EQTPPRDLRQ RVRHLQDTVL GSARAKIHSL IAFWKGILAI ERLDDQFHGR
661 EQKIIPKKTY LANKTGFMNA LSFSGAVRVD KKGNPWGGMI EIYPGGISRT CTQCGTVWLA
721 RRPKNPGHRD AMVVIPDIVD DAAATGFDNV DCDAGTVDYG ELFTLSREWV RLTPRYSRVM
781 RGTLGDLERA IRQGDDRKSR QMLELALEPQ PQWGQFFCHR CGFNGQSDVL AATNLARRAI
841 SLIRRLPDTD TPPTP
```

FIG. 33C

| Portion | Sequence (e.g., for use with DpbCasX) | SEQ ID NO: |
|---|---|---|
| F | GGCGCGTTTATTCCATTACTTTGGAGCCAGTCCCAGCGACTATGTCGTATGGACGAAGCGCTTATTTATCGG | 825 |
| | GGCGCGUUUAUUCCAUUACUUUGGAGCCAGUCCCAGCGACUAUGUCGUAUGGACGAAGCGCUUAUUUAUCGG | 826 |
| | GCCAGUCCCAGCGACUAUGUCGUAUGGACGAAGCGCUUAUUUAUCGG | 827 |
| | GCCAGTCCCAGCGACTATGTCGTATGGACGAAGCGCTTATTTATCGG | 828 |
| | AUUACAUCUGGCGCGUUUAUUCCAUUACUUUGGAGCCAGUCCCAGCGACUAUGUCGUAUGGACGAAGCGCUUAUUUAUCGG | 829 |
| | ATTACATCTGGCGCGTTTATTCCATTACTTTGGAGCCAGTCCCAGCGACTATGTCGTATGGACGAAGCGCTTATTTATCGG | 830 |
| | ACAUCUGGCGCGUUUAUUCCAUUACUUUGGAGCCAGUCCCAGCGACUAUGUCGUAUGGACGAAGCGCUUAUUUAUCGGAGA | 831 |
| | ACATCTGGCGCGTTTATTCCATTACTTTGGAGCCAGTCCCAGCGACTATGTCGTATGGACGAAGCGCTTATTTATCGGAGA | 832 |
| | ACAUCUGGCGCGUUUAUUCCAUUACUUUGGAGCCAGUCCCAGCGACUAUGUCGUAUGGACGAAGCGCUUAUUUAUCGG | 833 |
| | ACATCTGGCGCGTTTATTCCATTACTTTGGAGCCAGTCCCAGCGACTATGTCGTATGGACGAAGCGCTTATTTATCGG | 834 |
| | AAGUAGUAAAUUACAUCUGGCGCGUUUAUUCCAUUACUUUGGAGCCAGUCCCAGCGACUAUGUCGUAUGGACGAAGCGCUUAUUUAUCGGAGA | 835 |
| | AAGTAGTAAATTACATCTGGCGCGTTTATTCCATTACTTTGGAGCCAGTCCCAGCGACTATGTCGTATGGACGAAGCGCTTATTTATCGGAGA | 836 |
| | UUAUUCCAUUACUUUGGAGCCAGUCCCAGCGACUAUGUCGUAUGGACGAAGCGCUUAUUUAUCGG | 837 |
| | TTATTCCATTACTTTGGAGCCAGTCCCAGCGACTATGTCGTATGGACGAAGCGCTTATTTATCGG | 838 |
| | UUAUUCCAUUACUUUGGAGCCAGUCCCAGCGACUAUGUCGUAUGGACGAAGCGCUUAUUUAUCGGAG | 839 |
| | TTATTCCATTACTTTGGAGCCAGTCCCAGCGACTATGTCGTATGGACGAAGCGCTTATTTATCGGAG | 840 |
| L | AGAGAAA | 841 |
| | GAGAAA | 842 |
| | GAAA | 843 |
| | AAAA | 844 |
| E | CCGAUAAGUAAAACGCAUCAAAGU | 845 |
| | CCGATAAGTAAAACGCATCAAAGT | 846 |
| | CCGAUAAGUAAAACGCAUCAAAGUAUUAAAUACUCGUAUUGCU | 847 |
| | CCGATAAGTAAAACGCATCAAAGTATTAAATACTCGTATTGCT | 848 |
| | AUUUGAAGGUAUCUCCGAUAAGUAAAACGCAUCAAAG | 849 |
| | ATTTGAAGGTATCTCCGATAAGTAAAACGCATCAAAG | 850 |
| | CCGAUAAGUAAAACGCAUCAAAG | 851 |
| | CCGATAAGTAAAACGCATCAAAG | 852 |

FIG. 34A

| Portion | Sequence (e.g., for use with PlaCasX) | SEQ ID NO: |
|---|---|---|
| F | UUAUCUCAUUACUUUGAGAGCCAUCACCAGCGACUAUGUCGUAUGGGUAAAGCGCUUAUUUAUCGG | 853 |
| | TTATCTCATTACTTTGAGAGCCATCACCAGCGACTATGTCGTATGGGTAAAGCGCTTATTTATCGG | 854 |
| | UUAUCUCAUUACUUUGAGAGCCAUCACCAGCGACUAUGUCGUAUGGGUAAAGCGCUUAUUUAUCGGAGA | 855 |
| | TTATCTCATTACTTTGAGAGCCATCACCAGCGACTATGTCGTATGGGTAAAGCGCTTATTTATCGGAGA | 856 |
| L | AGAGAAA | 857 |
| | GAGAAA | 858 |
| | GAAA | 859 |
| | AAAA | 860 |
| E | UCUCCGAUAAAUAAGAAGCAUCAAAG | 861 |
| | TCTCCGATAAATAAGAAGCATCAAAG | 862 |

FIG. 34B

| Portion | Sequence (e.g., for use with CanCasX) | SEQ ID NO: |
|---|---|---|
| F | UAAAUUUUUUGAGCCCUAUCUCCGCGAGGAAGACAGGGCUCUUUUCAUGAGAGGAAGCUUUUAUACCCGACCGGUAAUCCGGUCGGGGGAUUGGCCGUUGAAACGAUUUUAAAGCGGCCAAUGGGCCCCUCUAUAUGGAUACUACUUAUAUAAGGAGCUUGGGGAAGAAGAUAGCUUAAUCCCGCUAUCUUGUCAAGGGGUUGGGGGAGUAUCAGUAUCCGGCAGGCGCC | 863 |
| | TAAATTTTTTGAGCCCTATCTCCGCGAGGAAGACAGGGCTCTTTTCATGAGAGGAAGCTTTTATACCCGACCGGTAATCCGGTCGGGGGATTGGCCGTTGAAACGATTTTAAAGCGGCCAATGGGCCCCTCTATATGGATACTACTTATATAAGGAGCTTGGGGAAGAAGATAGCTTAATCCCGCTATCTTGTCAAGGGGTTGGGGGAGTATCAGTATCCGGCAGGCGCC | 864 |
| | UCAUGAGAGGAAGCUUUUAUACCCGACCGGUAAUCCGGUCGGGGGAUUGGCCGUUGAAAC | 865 |
| | TCATGAGAGGAAGCTTTTATACCCGACCGGTAATCCGGTCGGGGGATTGGCCGTTGAAAC | 866 |
| L | AGAGAAA | 867 |
| | GAGAAA | 868 |
| | GAAA | 869 |
| | AAAA | 870 |
| E | GUUUACACACUCCCUCUCAUAGGGU | 871 |
| | GTTTACACACTCCCTCTCATAGGGT | 872 |
| | GUUUACACACUCCCUCUCAUGAGGU | 873 |
| | GTTTACACACTCCCTCTCATGAGGT | 874 |
| | UUUUACAUACCCCCUCUCAUGGGAU | 875 |
| | TTTTACATACCCCCTCTCATGGGAT | 876 |
| | GUUUACACACUCCCUCUCAUGGGGG | 877 |
| | GTTTACACACTCCCTCTCATGGGGG | 878 |

FIG. 34C

| | Exemplary synthetic guiding components, F-L-E-(V)-(D) | SEQ ID NO: |
|---|---|---|
| Dpb | GGCGCGUUUAUUCCAUUACUUUGGAGCCAGUCCCAGCGACUAUGUCGUAUGGACGAAGCGCUUAUUUAUCGG-AGAGAAA-CCGAUAAGUAAAACGCAUCAAAGU-(V)-(D) | 879 |
| | GGCGCGTTTATTCCATTACTTTGGAGCCAGTCCCAGCGACTATGTCGTATGGACGAAGCGCTTATTTATCGG-AGAGAAA-CCGATAAGTAAAACGCATCAAAGT-(V)-(D) | 880 |
| | GCCAGUCCCAGCGACUAUGUCGUAUGGACGAAGCGCUUAUUUAUCGG-AGAGAAA-CCGAUAAGUAAAACGCAUCAAAGUAUUAAAUACUCGUAU UGCU-(V)-(D) | 881 |
| | GCCAGTCCCAGCGACTATGTCGTATGGACGAAGCGCTTATTTATCGG-AGAGAAA-CCGATAAGTAAAACGCATCAAAGTATTAAATACTCGTAT TGCT-(V)-(D) | 882 |
| | AUUACAUCUGGCGCGUUUAUUCCAUUACUUUGGAGCCAGUCCCAGCGACUAUGUCGUAUGGACGAAGCGCUUAUUUAUCGG-AGAGAAA-CCGAUAAGUAAAACGCAUCAAAGUAU UAAAUACUCGUAUUGCU-(V)-(D) | 883 |
| | ATTACATCTGGCGCGTTTATTCCATTACTTTGGAGCCAGTCCCAGCGACTATGTCGTATGGACGAAGCGCTTATTTATCGG-AGAGAAA-CCGATAAGTAAAACGCATCAAAGTAT TAAATACTCGTATTGCT-(V)-(D) | 884 |
| | UUAUUCCAUUACUUUGGAGCCAGUCCCAGCGACUAUGUCGUAUGGACGAAGCGCUUAUUUAUCGG-GAAA-CCGAUAAGUAAAACGCAUCAAAG-(V)-(D) | 885 |
| | TTATTCCATTACTTTGGAGCCAGTCCCAGCGACTATGTCGTATGGACGAAGCGCTTATTTATCGG-GAAA-CCGATAAGTAAAACGCATCAAAG-(V)-(D) | 886 |
| | UUAUUCCAUUACUUUGGAGCCAGUCCCAGCGACUAUGUCGUAUGGACGAAGCGCUUAUUUAUCGGAGA-GAAA-CCGAUAAGUAAAACGCAUCAAAG-(V)-(D) | 887 |
| | TTATTCCATTACTTTGGAGCCAGTCCCAGCGACTATGTCGTATGGACGAAGCGCTTATTTATCGGAGA-GAAA-CCGATAAGTAAAACGCATCAAAG-(V)-(D) | 888 |
| | ACAUCUGGCGCGUUUAUUCCAUUACUUUGGAGCCAGUCCCAGCGACUAUGUCGUAUGGACGAAGCGCUUAUUUAUCGGAGA-GAAA-CCGAUAAGUAAAACGCAUCAAAG-(V)-(D) | 889 |
| | ACATCTGGCGCGTTTATTCCATTACTTTGGAGCCAGTCCCAGCGACTATGTCGTATGGACGAAGCGCTTATTTATCGGAGA-GAAA-CCGATAAGTAAAACGCATCAAAG-(V)-(D) | 890 |
| | ACAUCUGGCGCGUUUAUUCCAUUACUUUGGAGCCAGUCCCAGCGACUAUGUCGUAUGGACGAAGCGCUUAUUUAUCGG-GAAA-CCGAUAAGUAAAACGCAUCAAAG-(V)-(D) | 891 |
| | ACATCTGGCGCGTTTATTCCATTACTTTGGAGCCAGTCCCAGCGACTATGTCGTATGGACGAAGCGCTTATTTATCGG-GAAA-CCGATAAGTAAAACGCATCAAAG-(V)-(D) | 892 |
| Pla | UUAUCUCAUUACUUUGAGAGCCAUCACCAGCGACUAUGUCGUAUGGUAAAGCGCUUAUUUAUCGG-GAAA-UCUCCGAUAAAUAAGAAGCAUCAAAG-(V)-(D) | 893 |
| | TTATCTCATTACTTTGAGAGCCATCACCAGCGACTATGTCGTATGGTAAAGCGCTTATTTATCGG-GAAA-TCTCCGATAAATAAGAAGCATCAAAG-(V)-(D) | 894 |
| | UUAUCUCAUUACUUUGAGAGCCAUCACCAGCGACUAUGUCGUAUGGUAAAGCGCUUAUUUAUCGGAGA-GAAA-UCUCCGAUAAAUAAGAAGCAUCAAAG-(V)-(D) | 895 |
| | TTATCTCATTACTTTGAGAGCCATCACCAGCGACTATGTCGTATGGTAAAGCGCTTATTTATCGGAGA-GAAA-TCTCCGATAAATAAGAAGCATCAAAG-(V)-(D) | 896 |
| Can | UAAAAUUUUUGAGCCCUAUCUCCGGAGGAAGACAGGCCUCUUUUCAUGAGAGGAAGCUUUUUAUACCGGUAAUCCGGUAAUCGGTAATCCGGTAATCCGGTAATCCGGTAATCCGGTAATCCGGTAATCCGGTAATCCGGTAATCCGGGGAUUGGCCGUUGAAACGAUUUAAAGC GGCCAAUGGCCCCUCUAUAUGGAUAACUACUACUUAUAUAAGGAGCUUGGGAAGAAGAUAGCUUAAUCCGCUAUCUUGUCAAGGGUGGGAGUAUCAGTATCC GAAA-GUUUACACACUCCCUCAUAGGGU-(V)-(D) | 897 |
| | TAAATTTTTGAGCCCTATCTCCGGAGGAAGACAGGCTCTTTTCATGAGAGGAAGCTTTTTATACCGGTAATCCGGTCGGGGATTGGCCGTTGAAACGATTTT AAAGCGGCCAATGGCCCCTCTATATGGATAACTACTACTTATATAAGGAGCTTGGGAAGAAGATAGCTTAATCCGCTATCTTGTCAAGGGTTGGGGAGTATCAGTATCC GGCAGGCGCC-GAAA-GTTTACACACTCCCTCATAGGT-(V)-(D) | 898 |
| | UAAAAUUUUUGAGCCCUAUCUCCGGAGGAAGACAGGCCUCUUUUCAUGAGAGGAAGCUUUUUAUACCGGUAAUCCGGUAUCUUGUCAUGGGGAGAUUGGCCGUUGAAACGAUUUAAAGC GGCCAAUGGCCCCUCUAUAUGGAUAACUACUACUUAUAUAAGGAGCUUGGGGAAGAAGAUAGCUUAAUCCGCUAUCUUGUCAAGGGUGGGGAGUAUCAGGCGCC- GAAA-GUUUACACACUCCCUCAUGAGGU-(V)-(D) | 899 |
| | TAAATTTTTGAGCCCTATCTCCGGAGGAAGACAGGCTCTTTTCATGAGAGGAAGCTTTTTATACCGGTAATCCGGTCGGGGATTGGCCGTTGAAACGATTTTAAAGC GGCCAATGGCCCCTCTATATGGATAACTACTACTTATATAAGGAGCTTGGGGAAGAAGATAGCTTAATCCGCTATCTTGTCAAGGGTGGGGAGTATCAGTATCCGGCAGGCGCC- GAAA-GTTTACACACTCCCTCATGAGT-(V)-(D) | 900 |
| | UCAUGAGAGGAAGCUUUUUAUACCGGUAAUCCGGUCGGGGAUUGGCCGUUGAAAC-GAAA-GUUUACACACUCCCUCAUAGGGU-(V)-(D) | 901 |
| | ATGAGAGGAAGCTTTTTATACCGGTAATCCGGTCGGGGATTGGCCGTTGAAAC-GAAA-GTTTACACACTCCCTCATAGGGT-(V)-(D) | 902 |

FIG. 35

LshCas13a (*Leptotrichia shahii* Cas13a, SEQ ID NO:910)
```
   1 MGNLFGHKRW YEVRDKKDFK IKRKVKVKRN YDGNKYILNI NENNNKEKID NNKFIRKYIN
  61 YKKNDNILKE FTRKFHAGNI LFKLKGKEGI IRIENNDDFL ETEEVVLYIE AYGKSEKLKA
 121 LGITKKKIID EAIRQGITKD DKKIEIKRQE NEEEIEIDIR DEYTNKTLND CSIILRIIEN
 181 DELETKKSIY EIFKNINMSL YKIIEKIIEN ETEKVFENRY YEEHLREKLL KDDKIDVILT
 241 NFMEIREKIK SNLEILGFVK FYLNVGGDKK KSKNKKMLVE KILNINVDLT VEDIADFVIK
 301 ELEFWNITKR IEKVKKVNNE FLEKRRNRTY IKSYVLLDKH EKFKIERENK KDKIVKFFVE
 361 NIKNNSIKEK IEKILAEFKI DELIKKLEKE LKKGNCDTEI FGIFKKHYKV NFDSKKFSKK
 421 SDEEKELYKI IYRYLKGRIE KILVNEQKVR LKKMEKIEIE KILNESILSE KILKRVKQYT
 481 LEHIMYLGKL RHNDIDMTTV NTDDFSRLHA KEELDLELIT FFASTNMELN KIFSRENINN
 541 DENIDFFGGD REKNYVLDKK ILNSKIKIIR DLDFIDNKNN ITNNFIRKFT KIGTNERNRI
 601 LHAISKERDL QGTQDDYNKV INIIQNLKIS DEEVSKALNL DVVFKDKKNI ITKINDIKIS
 661 EENNNDIKYL PSFSKVLPEI LNLYRNNPKN EPFDTIETEK IVLNALIYVN KELYKKLILE
 721 DDLEENESKN IFLQELKKTL GNIDEIDENI IENYYKNAQI SASKGNNKAI KKYQKKVIEC
 781 YIGYLRKNYE ELFDFSDFKM NIQEIKKQIK DINDNKTYER ITVKTSDKTI VINDDFEYII
 841 SIFALLNSNA VINKIRNRFF ATSVWLNTSE YQNIIDILDE IMQLNTLRNE CITENWNLNL
 901 EEFIQKMKEI EKDFDDFKIQ TKKEIFNNYY EDIKNNILTE FKDDINGCDV LEKKLEKIVI
 961 FDDETKFEID KKSNILQDEQ RKLSNINKKD LKKKVDQYIK DKDQEIKSKI LCRIIFNSDF
1021 LKKYKKEIDN LIEDMESENE NKFQEIYYPK ERKNELYIYK KNLFLNIGNP NFDKIYGLIS
1081 NDIKMADAKF LFNIDGKNIR KNKISEIDAI LKNLNDKLNG YSKEYKEKYI KKLKENDDFF
1141 AKNIQNKNYK SFEKDYNRVS EYKKIRDLVE FNYLNKIESY LIDINWKLAI QMARFERDMH
1201 YIVNGLRELG IIKLSGYNTG ISRAYPKRNG SDGFYTTTAY YKFFDEESYK KFEKICYGFG
1261 IDLSENSEIN KPENESIRNY ISHFYIVRNP FADYSIAEQI DRVSNLLSYS TRYNNSTYAS
1321 VFEVFKKDVN LDYDELKKKF KLIGNNDILE RLMKPKKVSV LELESYNSDY IKNLIIELLT
1381 KIENTNDTL
```

FIG. 36A

LwaCas13a (*Leptotrichia wadei* Cas13a, SEQ ID NO:911)
```
   1 MKVTKVDGIS HKKYIEEGKL VKSTSEENRT SERLSELLSI RLDIYIKNPD NASEEENRIR
  61 RENLKKFFSN KVLHLKDSVL YLKNRKEKNA VQDKNYSEED ISEYDLKNKN SFSVLKKILL
 121 NEDVNSEELE IFRKDVEAKL NKINSLKYSF EENKANYQKI NENNVEKVGG KSKRNIIYDY
 181 YRESAKRNDY INNVQEAFDK LYKKEDIEKL FFLIENSKKH EKYKIREYYH KIIGRKNDKE
 241 NFAKIIYEEI QNVNNIKELI EKIPDMSELK KSQVFYKYYL DKEELNDKNI KYAFCHFVEI
 301 EMSQLLKNYV YKRLSNISND KIKRIFEYQN LKKLIENKLL NKLDTYVRNC GKYNYYLQVG
 361 EIATSDFIAR NRQNEAFLRN IIGVSSVAYF SLRNILETEN ENDITGRMRG KTVKNNKGEE
 421 KYVSGEVDKI YNENKQNEVK ENLKMFYSYD FNMDNKNEIE DFFANIDEAI SSIRHGIVHF
 481 NLELEGKDIF AFKNIAPSEI SKKMFQNEIN EKKLKLKIFK QLNSANVFNY YEKDVIIKYL
 541 KNTKFNFVNK NIPFVPSFTK LYNKIEDLRN TLKFFWSVPK DKEEKDAQIY LLKNIYYGEF
 601 LNKFVKNSKV FFKITNEVIK INKQRNQKTG HYKYQKFENI EKTVPVEYLA IIQSREMINN
 661 QDKEEKNTYI DFIQQIFLKG FIDYLNKNNL KYIESNNNND NNDIFSKIKI KKDNKEKYDK
 721 ILKNYEKHNR NKEIPHEINE FVREIKLGKI LKYTENLNMF YLILKLLNHK ELTNLKGSLE
 781 KYQSANKEET FSDELELINL LNLDNNRVTE DFELEANEIG KFLDFNENKI KDRKELKKFD
 841 TNKIYFDGEN IIKHRAFYNI KKYGMLNLLE KIADKAKYKI SLKELKEYSN KKNEIEKNYT
 901 MQQNLHRKYA RPKKDEKFND EDYKEYEKAI GNIQKYTHLK NKVEFNELNL LQGLLLKILH
 961 RLVGYTSIWE RDLRFRLKGE FPENHYIEEI FNFDNSKNVK YKSGQIVEKY INFYKELYKD
1021 NVEKRSIYSD KKVKKLKQEK KDLYIRNYIA HFNYIPHAEI SLLEVLENLR KLLSYDRKLK
1081 NAIMKSIVDI LKEYGFVATF KIGADKKIEI QTLESEKIVH LKNLKKKKLM TDRNSEELCE
1141 LVKVMFEYKA LE
```

FIG. 36B

LseCas13a (*Listeria seeligeri* Cas13a, SEQ ID NO:912)
```
   1 MWISIKTLIH HLGVLFFCDY MYNRREKKII EVKTMRITKV EVDRKKVLIS RDKNGGKLVY
  61 ENEMQDNTEQ IMHHKKSSFY KSVVNKTICR PEQKQMKKLV HGLLQENSQE KIKVSDVTKL
 121 NISNFLNHRF KKSLYYFPEN SPDKSEEYRI EINLSQLLED SLKKQQGTFI CWESFSKDME
 181 LYINWAENYI SSKTKLIKKS IRNNRIQSTE SRSGQLMDRY MKDILNKNKP FDIQSVSEKY
 241 QLEKLTSALK ATFKEAKKND KEINYKLKST LQNHERQIIE ELKENSELNQ FNIEIRKHLE
 301 TYFPIKKTNR KVGDIRNLEI GEIQKIVNHR LKNKIVQRIL QEGKLASYEI ESTVNSNSLQ
 361 KIKIEEAFAL KFINACLFAS NNLRNMVYPV CKKDILMIGE FKNSFKEIKH KKFIRQWSQF
 421 FSQEITVDDI ELASWGLRGA IAPIRNEIIH LKKHSWKKFF NNPTFKVKKS KIINGKTKDV
 481 TSEFLYKETL FKDYFYSELD SVPELIINKM ESSKILDYYS SDQLNQVFTI PNFELSLLTS
 541 AVPFAPSFKR VYLKGFDYQN QDEAQPDYNL KLNIYNEKAF NSEAFQAQYS LFKMVYYQVF
 601 LPQFTTNNDL FKSSVDFILT LNKERKGYAK AFQDIRKMNK DEKPSEYMSY IQSQLMLYQK
 661 KQEEKEKINH FEKFINQVFI KGFNSFIEKN RLTYICHPTK NTVPENDNIE IPFHTDMDDS
 721 NIAFWLMCKL LDAKQLSELR NEMIKFSCSL QSTEEISTFT KAREVIGLAL LNGEKGCNDW
 781 KELFDDKEAW KKNMSLYVSE ELLQSLPYTQ EDGQTPVINR SIDLVKKYGT ETILEKLFSS
 841 SDDYKVSAKD IAKLHEYDVT EKIAQQESLH KQWIEKPGLA RDSAWTKKYQ NVINDISNYQ
 901 WAKTKVELTQ VRHLHQLTID LLSRLAGYMS IADRDFQFSS NYILERENSE YRVTSWILLS
 961 ENKNKNKYND YELYNLKNAS IKVSSKNDPQ LKVDLKQLRL TLEYLELFDN RLKEKRNNIS
1021 HFNYLNGQLG NSILELFDDA RDVLSYDRKL KNAVSKSLKE ILSSHGMEVT FKPLYQTNHH
1081 LKIDKLQPKK IHHLGEKSTV SSNQVSNEYC QLVRTLLTMK
```

FIG. 36C

LbuCas13a (*Leptotrichia buccalis* Cas13a, SEQ ID NO:913)
```
   1 MKVTKVGGIS HKKYTSEGRL VKSESEENRT DERLSALLNM RLDMYIKNPS STETKENQKR
  61 IGKLKKFFSN KMVYLKDNTL SLKNGKKENI DREYSETDIL ESDVRDKKNF AVLKKIYLNE
 121 NVNSEELEVF RNDIKKKLNK INSLKYSFEK NKANYQKINE NNIEKVEGKS KRNIIYDYYR
 181 ESAKRDAYVS NVKEAFDKLY KEEDIAKLVL EIENLTKLEK YKIREFYHEI IGRKNDKENF
 241 AKIIYEEIQN VNNMKELIEK VPDMSELKKS QVFYKYYLDK EELNDKNIKY AFCHFVEIEM
 301 SQLLKNYVYK RLSNISNDKI KRIFEYQNLK KLIENKLLNK LDTYVRNCGK YNYYLQDGEI
 361 ATSDFIARNR QNEAFLRNII GVSSVAYFSL RNILETENEN DITGRMRGKT VKNNKGEEKY
 421 VSGEVDKIYN ENKKNEVKEN LKMFYSYDFN MDNKNEIEDF FANIDEAISS IRHGIVHFNL
 481 ELEGKDIFAF KNIAPSEISK KMFQNEINEK KLKLKIFRQL NSANVFRYLE KYKILNYLKR
 541 TRFEFVNKNI PFVPSFTKLY SRIDDLKNSL GIYWKTPKTN DDNKTKEIID AQIYLLKNIY
 601 YGEFLNYFMS NNGNFFEISK EIIELNKNDK RNLKTGFYKL QKFEDIQEKI PKEYLANIQS
 661 LYMINAGNQD EEEKDTYIDF IQKIFLKGFM TYLANNGRLS LIYIGSDEET NTSLAEKKQE
 721 FDKFLKKYEQ NNNIKIPYEI NEFLREIKLG NILKYTERLN MFYLILKLLN HKELTNLKGS
 781 LEKYQSANKE EAFSDQLELI NLLNLDNNRV TEDFELEADE IGKFLDFNGN KVDKNELKK
 841 FDTNKIYFDG ENIIKHRAFY NIKKYGMLNL LEKIADKAGY KISIEELKKY SNKKNEIEKN
 901 HKMQENLHRK YARPRKDEKF TDEDYESYKQ AIENIEEYTH LKNKVEFNEL NLLQGLLLRI
 961 LHRLVGYTSI WERDLRFRLK GEFPENQYIE EIFNFENKKN VKYKGGQIVE KYIKFYKELH
1021 QNDEVKINKY SSANIKVLKQ EKKDLYIRNY IAHFNYIPHA EISLLEVLEN LRKLLSYDRK
1081 LKNAVMKSVV DILKEYGFVA TFKIGADKKI GIQTLESEKI VHLKNLKKKK LMTDRNSEEL
1141 CKLVKIMFEY KMEEKKSEN
```

FIG. 36D

| Portion | Sequence (e.g., for use with LshCas13a) | SEQ ID NO: |
|---|---|---|
| F | CCACCCC | 915 |
| | CACCCC | 916 |
| | GGAUAUAGACCACCCC | 917 |
| | GGATATAGACCACCCC | 918 |
| L | AAUAUCGAA | 919 |
| | AATATCGAA | 920 |
| | AGAA | 921 |
| | AAAA | 922 |
| E | GGGGACUAAAAC | 923 |
| | GGGGACTAAAAC | 924 |
| | GGGGA | 925 |
| | CCACCCCAAUAUCGAAGGGGACUAAAAC | 926 |
| | CCACCCCAATATCGAAGGGGACTAAAAC | 927 |
| | CACCCCAAUAUCGAAGGGGA | 928 |
| | CACCCCAATATCGAAGGGGA | 929 |
| | GGAUAUAGACCACCCCAAUAUCGAAGGGGA | 930 |
| | GGATATAGACCACCCCAATATCGAAGGGGA | 931 |

FIG. 37A

| Portion | Sequence (e.g., for use with LwaCas13a) | SEQ ID NO: |
|---|---|---|
| F | GAUUUAGACUACCCC | 932 |
| | GATTTAGACTACCCC | 933 |
| | GAUUUAGAACCCC | 934 |
| | GATTTAGAACCCC | 935 |
| | CACCCC | 936 |
| L | AAAAACGAA | 937 |
| | AGAA | 938 |
| | AAAA | 939 |
| E | GGGGACTAAAAC | 940 |
| | GGGGACUAAAAC | 941 |
| | GGGGA | 942 |
| | GAUUUAGACUACCCCAAAAACGAAGGGGACUAAAAC | 943 |
| | GATTTAGACTACCCCAAAAACGAAGGGGACTAAAAC | 944 |
| | GAUUUAGAACCCCAAAAACGAAGGGGACUAAAAC | 945 |
| | GATTTAGAACCCCAAAAACGAAGGGGACTAAAAC | 946 |

FIG. 37B

| Portion | Sequence (e.g., for use with LseCas13a) | SEQ ID NO: |
|---|---|---|
| F | GGUAAGAGACUACCUCU | 947 |
| | GGTAAGAGACTACCTCT | 948 |
| | GUAAGAGACUACCUCU | 949 |
| | GTAAGAGACTACCTCT | 950 |
| | GACUACCUCU | 951 |
| | GACTACCTCT | 952 |
| | ACUACCUCU | 953 |
| | ACTACCTCT | 954 |
| L | AUAUGAAA | 955 |
| | ATATGAAA | 956 |
| | AAAA | 957 |
| E | GAGGACUAAAAC | 958 |
| | GAGGACTAAAAC | 959 |
| | AGAGGA | 960 |
| | GUAAGAGACUACCUCUAUAUGAAAGAGGACUAAAAC | 961 |
| | GTAAGAGACTACCTCTATATGAAAGAGGACTAAAAC | 962 |
| | ACUACCUCUAUAUGAAAGAGGACUAAAAC | 963 |
| | ACTACCTCTATATGAAAGAGGACTAAAAC | 964 |
| | GACUACCUCUAUAUGAAAGAGGA | 965 |
| | GACTACCTCTATATGAAAGAGGA | 966 |
| | GGUAAGAGACUACCUCUAUAUGAAAGAGGA | 967 |
| | GGTAAGAGACTACCTCTATATGAAAGAGGA | 968 |

FIG. 37C

| Portion | Sequence (e.g., for use with LbuCas13a) | SEQ ID NO: |
|---|---|---|
| F | GGAUUUAGACCACCCC | 969 |
| | GGATTTAGACCACCCC | 970 |
| | GACCACCCC | 971 |
| L | AAAAAUGAA | 972 |
| | AAAAATGAA | 973 |
| | AAAA | 974 |
| E | UGGGGA | 975 |
| | TGGGGA | 976 |
| | GGGGA | 977 |
| | GGAUUUAGACCACCCCAAAAAUGAAGGGGA | 978 |
| | GGATTTAGACCACCCCAAAAATGAAGGGGA | 979 |
| | GACCACCCCAAAAAUGAAGGGGA | 980 |
| | GACCACCCCAAAAATGAAGGGGA | 981 |

FIG. 37D

| | Exemplary synthetic guiding components, F-L-E-(V)-(D) or E-(V)-(D) | SEQ ID NO: |
|---|---|---|
| LshCas13a | CCACCCC-AAUAUCGAA-GGGGACUAAAAC-(V)-(D) | 982 |
| | CCACCCC-AATATCGAA-GGGGACTAAAAC-(V)-(D) | 983 |
| | CACCCC-AAUAUCGAA-GGGGA-(V)-(D) | 984 |
| | CACCCC-AATATCGAA-GGGGA-(V)-(D) | 985 |
| | GGAUAUAGACCACCCC-AAUAUCGAA-GGGGA-(V)-(D) | 986 |
| | GGATATAGACCACCCC-AATATCGAA-GGGGA-(V)-(D) | 987 |
| LwaCas13a | GAUUUAGACUACCCC-AAAAACGAA-GGGGACUAAAAC-(V)-(D) | 988 |
| | GATTTAGACTACCCC-AAAAACGAA-GGGGACTAAAAC-(V)-(D) | 989 |
| | GAUUUAGAACCCC-AAAAACGAA-GGGGACUAAAAC-(V)-(D) | 990 |
| | GATTTAGAACCCC-AAAAACGAA-GGGGACTAAAAC-(V)-(D) | 991 |
| LseCas13a | GUAAGAGACUACCUCU-AUAUGAAA-GAGGACUAAAAC-(V)-(D) | 992 |
| | GTAAGAGACTACCTCT-ATATGAAA-GAGGACTAAAAC-(V)-(D) | 993 |
| | ACUACCUCU-AUAUGAAA-GAGGACUAAAAC-(V)-(D) | 994 |
| | ACTACCTCT-ATATGAAA-GAGGACTAAAAC-(V)-(D) | 995 |
| | GACUACCUCU-AUAUGAA-AGAGGA-(V)-(D) | 996 |
| | GACTACCTCT-ATATGAA-AGAGGA-(V)-(D) | 997 |
| | GGUAAGAGACUACCUCU-AUAUGAA-AGAGGA-(V)-(D) | 998 |
| | GGTAAGAGACTACCTCT-ATATGAA-AGAGGA-(V)-(D) | 999 |
| LbuCas13a | GGAUUUAGACCACCCC-AAAAAUGAA-GGGGA-(V)-(D) | 1000 |
| | GGATTTAGACCACCCC-AAAAATGAA-GGGGA-(V)-(D) | 1001 |
| | GACCACCCC-AAAAAUGAA-GGGGA-(V)-(D) | 1002 |
| | GACCACCCC-AAAAATGAA-GGGGA-(V)-(D) | 1003 |

FIG. 38

```
BzoCas13b (Bergeyella zoohelcum ATCC 43767 Cas13b, SEQ ID NO:1005)
   1 MENKTSLGNN IYYNPFKPQD KSYFAGYFNA AMENTDSVFR ELGKRLKGKE YTSENFFDAI
  61 FKENISLVEY ERYVKLLSDY FPMARLLDKK EVPIKERKEN FKKNFKGIIK AVRDLRNFYT
 121 HKEHGEVEIT DEIFGVLDEM LKSTVLTVKK KKVKTDKTKE ILKKSIEKQL DILCQKKLEY
 181 LRDTARKIEE KRRNQRERGE KELVAPFKYS DKRDDLIAAI YNDAFDVYID KKKDSLKESS
 241 KAKYNTKSDP QQEEGDLKIP ISKNGVVFLL SLFLTKQEIH AFKSKIAGFK ATVIDEATVS
 301 EATVSHGKNS ICFMATHEIF SHLAYKKLKR KVRTAEINYG EAENAEQLSV YAKETLMMQM
 361 LDELSKVPDV VYQNLSEDVQ KTFIEDWNEY LKENNGDVGT MEEEQVIHPV IRKRYEDKFN
 421 YFAIRFLDEF AQFPTLRFQV HLGNYLHDSR PKENLISDRR IKEKITVFGR LSELEHKKAL
 481 FIKNTETNED REHYWEIFPN PNYDFPKENI SVNDKDFPIA GSILDREKQP VAGKIGIKVK
 541 LLNQQYVSEV DKAVKAHQLK QRKASKPSIQ NIIEEIVPIN ESNPKEAIVF GGQPTAYLSM
 601 NDIHSILYEF FDKWEKKKEK LEKKGEKELR KEIGKELEKK IVGKIQAQIQ QIIDKDTNAK
 661 ILKPYQDGNS TAIDKEKLIK DLKQEQNILQ KLKDEQTVRE KEYNDFIAYQ DKNREINKVR
 721 DRNHKQYLKD NLKRKYPEAP ARKEVLYYRE KGKVAVWLAN DIKRFMPTDF KNEWKGEQHS
 781 LLQKSLAYYE QCKEELKNLL PEKVFQHLPF KLGGYFQQKY LYQFYTCYLD KRLEYISGLV
 841 QQAENFKSEN KVFKKVENEC FKFLKKQNYT HKELDARVQS ILGYPIFLER GFMDEKPTII
 901 KGKTFKGNEA LFADWFRYYK EYQNFQTFYD TENYPLVELE KKQADRKRKT KIYQQKKNDV
 961 FTLLMAKHIF KSVFKQDSID QFSLEDLYQS REERLGNQER ARQTGERNTN YIWNKTVDLK
1021 LCDGKITVEN VKLKNVGDFI KYEYDQRVQA FLKYEENIEW QAFLIKESKE EENYPYVVER
1081 EIEQYEKVRR EELLKEVHLI EEYILEKVKD KEILKKGDNQ NFKYYILNGL LKQLKNEDVE
1141 SYKVFNLNTE PEDVNINQLK QEATDLEQKA FVLTYIRNKF AHNQLPKKEF WDYCQEKYGK
1201 IEKEKTYAEY FAEVFKKEKE ALIK
```

FIG. 39A

PbuCas13b (*Prevotella buccae* ATCC 33574 Cas13b, SEQ ID NO:1006)
```
   1 MQKQDKLFVD RKKNAIFAFP KYITIMENKE KPEPIYYELT DKHFWAAFLN LARHNVYTTI
  61 NHINRRLEIA ELKDDGYMMG IKGSWNEQAK KLDKKVRLRD LIMKHFPFLE AAAYEMTNSK
 121 SPNNKEQREK EQSEALSLNN LKNVLFIFLE KLQVLRNYYS HYKYSEESPK PIFETSLLKN
 181 MYKVFDANVR LVKRDYMHHE NIDMQRDFTH LNRKKQVGRT KNIIDSPNFH YHFADKEGNM
 241 TIAGLLFFVS LFLDKKDAIW MQKKLKGFKD GRNLREQMTN EVFCRSRISL PKLKLENVQT
 301 KDWMQLDMLN ELVRCPKSLY ERLREKDRES FKVPFDIFSD DYNAEEEPFK NTLVRHQDRF
 361 PYFVLRYFDL NEIFEQLRFQ IDLGTYHFSI YNKRIGDEDE VRHLTHHLYG FARIQDFAPQ
 421 NQPEEWRKLV KDLDHFETSQ EPYISKTAPH YHLENEKIGI KFCSAHNNLF PSLQTDKTCN
 481 GRSKFNLGTQ FTAEAFLSVH ELLPMMFYYL LLTKDYSRKE SADKVEGIIR KEISNIYAIY
 541 DAFANNEINS IADLTRRLQN TNILQGHLPK QMISILKGRQ KDMGKEAERK IGEMIDDTQR
 601 RLDLLCKQTN QKIRIGKRNA GLLKSGKIAD WLVNDMMRFQ PVQKDQNNIP INNSKANSTE
 661 YRMLQRALAL FGSENFRLKA YFNQMNLVGN DNPHPFLAET QWEHQTNILS FYRNYLEARK
 721 KYLKGLKPQN WKQYQHFLIL KVQKTNRNTL VTGWKNSFNL PRGIFTQPIR EWFEKHNNSK
 781 RIYDQILSFD RVGFVAKAIP LYFAEEYKDN VQPFYDYPFN IGNRLKPKKR QFLDKKERVE
 841 LWQKNKELFK NYPSEKKKTD LAYLDFLSWK KFERELRLIK NQDIVTWLMF KELFNMATVE
 901 GLKIGEIHLR DIDTNTANEE SNNILNRIMP MKLPVKTYET DNKGNILKER PLATFYIEET
 961 ETKVLKQGNF KALVKDRRLN GLFSFAETTD LNLEEHPISK LSVDLELIKY QTTRISIFEM
1021 TLGLEKKLID KYSTLPTDSF RNMLERWLQC KANRPELKNY VNSLIAVRNA FSHNQYPMYD
1081 ATLFAEVKKF TLFPSVDTKK IELNIAPQLL EIVGKAIKEI EKSENKN
```

FIG. 39B

| Portion | Sequence (e.g., for use with BzoCas13b) | SEQ ID NO: |
|---|---|---|
| E | GUUGUGGAAGGUCC | 1010 |
|  | GTTGTGGAAGGTCC | 1011 |
|  | GUUGGAACUGCUCUC | 1012 |
|  | GTTGGAACTGCTCTC | 1013 |
|  | GUUGUGGAAGGUCCAGUUUUGGGGGCUAUUACAACA | 1014 |
|  | GTTGTGGAAGGTCCAGTTTTGGGGGCTATTACAACA | 1015 |
|  | GUUGGAACUGCUCUCAUUUUGGAGGGUAAUCACAAC | 1016 |
|  | GTTGGAACTGCTCTCATTTTGGAGGGTAATCACAAC | 1017 |
| L | AGUUUUGG | 1018 |
|  | AGTTTTGG | 1019 |
|  | AUUUUG | 1020 |
|  | ATTTTG | 1021 |
|  | AAAA | 1022 |
| F | GGGCUAUUACAACA | 1023 |
|  | GGGCTATTACAACA | 1024 |
|  | GAGGGUAAUCACAAC | 1025 |
|  | GAGGGTAATCACAAC | 1026 |

FIG. 40A

| Portion | Sequence (e.g., for use with PbuCas13b) | SEQ ID NO: |
|---|---|---|
| E | GUUGGAACUGCUCUCAUUUUAUUCGUGAAGUUUUUAUUUG | 1027 |
| | GTTGGAACTGCTCTCATTTTATTCGTGAAGTTTTTATTTG | 1028 |
| | GUUGGAACUGCUCUCAUUUUAUUCGUGAGUUUUUAUUG | 1029 |
| | GTTGGAACTGCTCTCATTTTATTCGTGAGTTTTTATTG | 1030 |
| | GUUGCAUCUGCCUUC | 1031 |
| | GTTGCATCTGCCTTC | 1032 |
| | GUUGGAACUGCUCUCAUUUUAUUCGUGAAGUUUUUAUUUGUUUUCAAAGGAACUCAUGAAUACAGAGUAUUUGGAGGGUAAUAACAAC | 1033 |
| | GTTGGAACTGCTCTCATTTTATTCGTGAAGTTTTTATTTGTTTTCAAAGGAACTCATGAATACAGAGTATTTGGAGGGTAATAACAAC | 1034 |
| | GUUGGAACUGCUCUCAUUUUAUUCGUGAGUUUUUAUUGUUUUUUCAAAGGAACUCAUGAAUGCAAAGCAUUUGGAGGGUAAUCACAAC | 1035 |
| | GTTGGAACTGCTCTCATTTTATTCGTGAGTTTTTATTGTTTTTTCAAAGGAACTCATGAATGCAAAGCATTTGGAGGGTAATCACAAC | 1036 |
| | GUUGCAUCUGCCUUCUUUUUGAAAGGUAAAAACAAC | 1037 |
| | GTTGCATCTGCCTTCTTTTTGAAAGGTAAAAACAAC | 1038 |
| L | UUUUUU | 1039 |
| | TTTTTT | 1040 |
| | UUUU | 1041 |
| | TTTT | 1042 |
| F | CAAAGGAACUCAUGAAUACAGAGUAUUUGGAGGGUAAUAACAAC | 1043 |
| | CAAAGGAACTCATGAATGCAAAGCATTTGGAGGGTAATCACAAC | 1044 |
| | GAAAGGUAAAAACAAC | 1045 |
| | GAAAGGTAAAAACAAC | 1046 |

FIG. 40B

| | Exemplary synthetic guiding components, (D)-(V)-E-L-F or (V)-E | SEQ ID NO: |
|---|---|---|
| BzoCas13B | (D)-(V)-GUUGUGGAAGGUCC-AGUUUUGG-GGGCUAUUACAACA | 1047 |
| | (D)-(V)-GTTGTGGAAGGTCC-AGTTTTGG-GGGCTATTACAACA | 1048 |
| | (D)-(V)-GUUGGAACUGCUCUC-AUUUUG-GAGGGUAAUCACAAC | 1049 |
| | (D)-(V)-GTTGGAACTGCTCTC-ATTTTG-GAGGGTAATCACAAC | 1050 |
| PbuCas13b | (D)-(V)-GUUGGAACUGCUCUCAUUUUAUUCGUGAAGUUUUUAUUUG-UUUU-CAAAGGAACUCAUGAAUACAGAGUAUUUGGAGGGUAAUAACAAC | 1051 |
| | (D)-(V)-GTTGGAACTGCTCTCATTTTATTCGTGAAGTTTTTATTTG-TTTT-CAAAGGAACTCATGAATACAGAGTATTTGGAGGGTAATAACAAC | 1052 |
| | (D)-(V)-GUUGGAACUGCUCUCAUUUUAUUCGUGAGUUUUUAUUG-UUUUUU-CAAAGGAACUCAUGAAUGCAAAGCAUUUGGAGGGUAAUCACAAC | 1053 |
| | (D)-(V)-GTTGGAACTGCTCTCATTTTATTCGTGAGTTTTTATTG-TTTTTT-CAAAGGAACTCATGAATGCAAAGCATTTGGAGGGTAATCACAAC | 1054 |
| | (D)-(V)-GUUGCAUCUGCCUUC-UUUUU-GAAAGGUAAAAACAAC | 1055 |
| | (D)-(V)-GTTGCATCTGCCTTC-TTTTT-GAAAGGTAAAAACAAC | 1056 |

FIG. 41

EsiCas13d-1 (*Eubacterium siraeum* DSM 15702 Cas13d, SEQ ID NO:1060)

```
  1 MGKKIHARDL REQRKTDRTE KFADQNKKRE AERAVPKKDA AVSVKSVSSV SSKKDNVTKS
 61 MAKAAGVKSV FAVGNTVYMT SFGRGNDAVL EQKIVDTSHE PLNIDDPAYQ LNVVTMNGYS
121 VTGHRGETVS AVTDNPLRRF NGRKKDEPEQ SVPTDMLCLK PTLEKKFFGK EFDDNIHIQL
181 IYNILDIEKI LAVYSTNAIY ALNNMSADEN IENSDFFMKR TTDETFDDFE KKKESTNSRE
241 KADFDAFEKF IGNYRLAYFA DAFYVNKKNP KGKAKNVLRE DKELYSVLTL IGKLRHWCVH
301 SEEGRAEFWL YKLDELKDDF KNVLDVVYNR PVEEINNRFI ENNKVNIQIL GSVYKNTDIA
361 ELVRSYYEFL ITKKYKNMGF SIKKLRESML EGKGYADKEY DSVRNKLYQM TDFILYTGYI
421 NEDSDRADDL VNTLRSSLKE DDKTTVYCKE ADYLWKKYRE SIREVADALD GDNIKKLSKS
481 NIEIQEDKLR KCFISYADSV SEFTKLIYLL TRFLSGKEIN DLVTTLINKF DNIRSFLEIM
541 DELGLDRTFT AEYSFFEGST KYLAELVELN SFVKSCSFDI NAKRTMYRDA LDILGIESDK
601 TEEDIEKMID NILQIDANGD KKLKKNNGLR NFIASNVIDS NRFKYLVRYG NPKKIRETAK
661 CKPAVRFVLN EIPDAQIERY YEACCPKNTA LCSANKRREK LADMIAEIKF ENFSDAGNYQ
721 KANVTSRTSE AEIKRKNQAI IRLYLTVMYI MLKNLVNVNA RYVIAFHCVE RDTKLYAESG
781 LEVGNIEKNK TNLTMAVMGV KLENGIIKTE FDKSFAENAA NRYLRNARWY KLILDNLKKS
841 ERAVVNEFRN TVCHLNAIRN ININIKEIKE VENYFALYHY LIQKHLENRF ADKKVERDTG
901 DFISKLEEHK TYCKDFVKAY CTPFGYNLVR YKNLTIDGLF DKNYPGKDDS DEQK
```

FIG. 42A

EsiCas13d-2 (*Eubacterium siraeum* DSM 15702 Cas13d, SEQ ID NO:1061)

```
  1 MGKKIHARDL REQRKTDRTE KFADQNKKRE AERAVPKKDA AVSVKSVSSV SSKKDNVTKS
 61 MAKAAGVKSV FAVGNTVYMT SFGRGNDAVL EQKIVDTSHE PLNIDDPAYQ LNVVTMNGYS
121 VTGHRGETVS AVTDNPLRRF NGRKKDEPEQ SVPTDMLCLK PTLEKKFFGK EFDDNIHIQL
181 IYNILDIEKI LAVYSTNAIY ALNNMSADEN IENSDFFMKR TTDETFDDFE KKKESTNSRE
241 KADFDAFEKF IGNYRLAYFA DAFYVNKKNP KGKAKNVLRE DKELYSVLTL IGKLAHWCVA
301 SEEGRAEFWL YKLDELKDDF KNVLDVVYNR PVEEINNRFI ENNKVNIQIL GSVYKNTDIA
361 ELVRSYYEFL ITKKYKNMGF SIKKLRESML EGKGYADKEY DSVRNKLYQM TDFILYTGYI
421 NEDSDRADDL VNTLRSSLKE DDKTTVYCKE ADYLWKKYRE SIREVADALD GDNIKKLSKS
481 NIEIQEDKLR KCFISYADSV SEFTKLIYLL TRFLSGKEIN DLVTTLINKF DNIRSFLEIM
541 DELGLDRTFT AEYSFFEGST KYLAELVELN SFVKSCSFDI NAKRTMYRDA LDILGIESDK
601 TEEDIEKMID NILQIDANGD KKLKKNNGLR NFIASNVIDS NRFKYLVRYG NPKKIRETAK
661 CKPAVRFVLN EIPDAQIERY YEACCPKNTA LCSANKRREK LADMIAEIKF ENFSDAGNYQ
721 KANVTSRTSE AEIKRKNQAI IRLYLTVMYI MLKNLVNVNA RYVIAFHCVE RDTKLYAESG
781 LEVGNIEKNK TNLTMAVMGV KLENGIIKTE FDKSFAENAA NRYLRNARWY KLILDNLKKS
841 ERAVVNEFAN TVCALNAIRN ININIKEIKE VENYFALYHY LIQKHLENRF ADKKVERDTG
901 DFISKLEEHK TYCKDFVKAY CTPFGYNLVR YKNLTIDGLF DKNYPGKDDS DEQK
```

FIG. 42B

RfxCas13d-1 (*Ruminococcus flavefaciens* strain XPD3002 Cas13d, SEQ ID NO:1062)
```
  1 MIEKKKSFAK GMGVKSTLVS GSKVYMTTFA EGSDARLEKI VEGDSIRSVN EGEAFSAEMA
 61 DKNAGYKIGN AKFSHPKGYA VVANNPLYTG PVQQDMLGLK ETLEKRYFGE SADGNDNICI
121 QVIHNILDIE KILAEYITNA AYAVNNISGL DKDIIGFGKF STVYTYDEFK DPEHHRAAFN
181 NNDKLINAIK AQYDEFDNFL DNPRLGYFGQ AFFSKEGRNY IINYGNECYD ILALLSGLRH
241 WVVHNNEEES RISRTWLYNL DKNLDNEYIS TLNYLYDRIT NELTNSFSKN SAANVNYIAE
301 TLGINPAEFA EQYFRFSIMK EQKNLGFNIT KLREVMLDRK DMSEIRKNHK VFDSIRTKVY
361 TMMDFVIYRY YIEEDAKVAA ANKSLPDNEK SLSEKDIFVI NLRGSFNDDQ KDALYYDEAN
421 RIWRKLENIM HNIKEFRGNK TREYKKKDAP RLPRILPAGR DVSAFSKLMY ALTMFLDGKE
481 INDLLTTLIN KFDNIQSFLK VMPLIGVNAK FVEEYAFFKD SAKIADELRL IKSFARMGEP
541 IADARRAMYI DAIRILGTNL SYDELKALAD TFSLDENGNK LKKGKHGMRN FIINNVISNK
601 RFHYLIRYGD PAHLHEIAKN EAVVKFVLGR IADIQKKQGQ NGKNQIDRYY ETCIGKDKGK
661 SVSEKVDALT KIITGMNYDQ FDKKRSVIED TGRENAEREK FKKIISLYLT VIYHILKNIV
721 NINARYVIGF HCVERDAQLY KEKGYDINLK KLEEKGFSSV TKLCAGIDET APDKRKDVEK
781 EMAERAKESI DSLESANPKL YANYIKYSDE KKAEEFTRQI NREKAKTALN AYLRNTKWNV
841 IIREDLLRID NKTCTLFRNK AVHLEVARYV HAYINDIAEV NSYFQLYHYI MQRIIMNERY
901 EKSSGKVSEY FDAVNDEKKY NDRLLKLLCV PFGYCIPRFK NLSIEALFDR NEAAKFDKEK
961 KKVSGNS
```

FIG. 42C

RfxCas13d-2 (*Ruminococcus flavefaciens* strain XPD3002 Cas13d, SEQ ID NO:1063)
```
  1 EASIEKKKSF AKGMGVKSTL VSGSKVYMTT FAEGSDARLE KIVEGDSIRS VNEGEAFSAE
 61 MADKNAGYKI GNAKFSHPKG YAVVANNPLY TGPVQQDMLG LKETLEKRYF GESADGNDNI
121 CIQVIHNILD IEKILAEYIT NAAYAVNNIS GLDKDIIGFG KFSTVYTYDE FKDPEHHRAA
181 FNNNDKLINA IKAQYDEFDN FLDNPRLGYF GQAFFSKEGR NYIINYGNEC YDILALLSGL
241 RHWVVHNNEE ESRISRTWLY NLDKNLDNEY ISTLNYLYDR ITNELTNSFS KNSAANVNYI
301 AETLGINPAE FAEQYFRFSI MKEQKNLGFN ITKLREVMLD RKDMSEIRKN HKVFDSIRTK
361 VYTMMDFVIY RYYIEEDAKV AAANKSLPDN EKSLSEKDIF VINLRGSFND DQKDALYYDE
421 ANRIWRKLEN IMHNIKEFRG NKTREYKKKD APRLPRILPA GRDVSAFSKL MYALTMFLDG
481 KEINDLLTTL INKFDNIQSF LKVMPLIGVN AKFVEEYAFF KDSAKIADEL RLIKSFARMG
541 EPIADARRAM YIDAIRILGT NLSYDELKAL ADTFSLDENG NKLKKGKHGM RNFIINNVIS
601 NKRFHYLIRY GDPAHLHEIA KNEAVVKFVL GRIADIQKKQ GQNGKNQIDR YYETCIGKDK
661 GKSVSEKVDA LTKIITGMNY DQFDKKRSVI EDTGRENAER EKFKKIISLY LTVIYHILKN
721 IVNINARYVI GFHCVERDAQ LYKEKGYDIN LKKLEEKGFS SVTKLCAGID ETAPDKRKDV
781 EKEMAERAKE SIDSLESANP KLYANYIKYS DEKKAEEFTR QINREKAKTA LNAYLRNTKW
841 NVIIREDLLR IDNKTCTLFR NKAVHLEVAR YVHAYINDIA EVNSYFQLYH YIMQRIIMNE
901 RYEKSSGKVS EYFDAVNDEK KYNDRLLKLL CVPFGYCIPR FKNLSIEALF DRNEAAKFDK
961 EKKKVSGNSG SG
```

FIG. 42D

AdmCas13d-1 (*Anaerobic digester* metagenome 15706 Cas13d, SEQ ID NO:1064)
```
  1 MNNKRKTKAK AAGLKSVFFD QKQAVLTTFA KGNNSQIEKK VVNSEVKDLR QPPAFDLELK
 61 EKTFYISGKN NINTSRENPL ASASLPLSKR QRIRAERIKR AREENRPYHN VKRVGEDDLR
121 AKADLEKHYF GKEYSDNLKI QIIYNILDIN KIISPYINDI VYSMNNLARN DEYIDGKIDV
181 IGSLSSTTDY SSFMSPNKDL EKEKKFSFHR ENYKKFVEAS KPYMRYYGKV FIRDVKKSKL
241 STGKGEKIEV MYRSDEEIFT IFQILSYVRQ SIMHNDIGNK SSILAIEKYP ARFVGFLSDL
301 LKTKTNDVNR MFIDNNSQTN FWVLFSIFGL QDHTSGADKI CRNFYDFVIK ADSKNLGFSL
361 KKIRELMLDL PNANMLRDHQ FDTVRSKFYT LLDFIIYQHY LEEKSRIDNM VEKLRMTLKE
421 EEKEVLYAAE AKIVWNAIGA KVINKLVPMM NGDALKEIKR KNRDRKLPQS VIATVQVNSD
481 ANVFSGLIYF LTLFLDGKEI NEMVSNLITK FENIDSLLHV DREIYKSDEK DLDLEIEKLA
541 LFFKGVVRPN AKTDTGAGEI SKSFSIFQSA ERIIEELKFI KNVTRMDNEI FPSEGVFLDA
601 ANVLGVRGDD FDFSNEFVGD DLHSDANKKI INKINGTKED RNLRNFIINN VVKSRRFQYI
661 ARHMNTHYVK QLANNETLNR FVLNKMGDAK IINRYYESIS GNTPNIEVRS QIDYLVKRLR
721 SFSFEDLNDV KQKVRPGTNE SIEKEKKKAL VGLCLTIQYL VYKNLVNINA RYTTAFYCLE
781 RDSKLKGFGV DVWRDFESYT ALTNHFIKEG YLPVRKAEIL RANLKHLDCE DGFKYYRNQV
841 THLNAIRVAY KYINEIKSVH SYFALYHYIM QRHLYDSLQA KAKDSSGFVI DALKKSFEHK
901 IYSKDLLHVL HSPFGYNTAR YKNLSIEALF DKNESRPEVN PLSTND
```
FIG. 42E AdmCas13d-2 (*Anaerobic digester* metagenome 15706, SEQ ID NO:1065)
```
  1 EASNNKRKTK AKAAGLKSVF FDQKQAVLTT FAKGNNSQIE KKVVNSEVKD LRQPPAFDLE
 61 LKEKTFYISG KNNINTSREN PLASASLPLS KRQRIRAERI KRAREENRPY HNVKRVGEDD
121 LRAKADLEKH YFGKEYSDNL KIQIIYNILD INKIISPYIN DIVYSMNNLA RNDEYIDGKI
181 DVIGSLSSTT DYSSFMSPNK DLEKEKKFSF HRENYKKFVE ASKPYMRYYG KVFIRDVKKS
241 KLSTGKGEKI EVMYRSDEEI FTIFQILSYV RQSIMHNDIG NKSSILAIEK YPARFVGFLS
301 DLLKTKTNDV NRMFIDNNSQ TNFWVLFSIF GLQDHTSGAD KICRNFYDFV IKADSKNLGF
361 SLKKIRELML DLPNANMLRD HQFDTVRSKF YTLLDFIIYQ HYLEEKSRID NMVEKLRMTL
421 KEEEKEVLYA AEAKIVWNAI GAKVINKLVP MMNGDALKEI KRKNRDRKLP QSVIATVQVN
481 SDANVFSGLI YFLTLFLDGK EINEMVSNLI TKFENIDSLL HVDREIYKSD EKDLDLEIEK
541 LALFFKGVVR PNAKTDTGAG EISKSFSIFQ SAERIIEELK FIKNVTRMDN EIFPSEGVFL
601 DAANVLGVRG DDFDFSNEFV GDDLHSDANK KIINKINGTK EDRNLRNFII NNVVKSRRFQ
661 YIARHMNTHY VKQLANNETL NRFVLNKMGD AKIINRYYES ISGNTPNIEV RSQIDYLVKR
721 LRSFSFEDLN DVKQKVRPGT NESIEKEKKK ALVGLCLTIQ YLVYKNLVNI NARYTTAFYC
781 LERDSKLKGF GVDVWRDFES YTALTNHFIK EGYLPVRKAE ILRANLKHLD CEDGFKYYRN
841 QVTHLNAIRV AYKYINEIKS VHSYFALYHY IMQRHLYDSL QAKAKDSSGF VIDALKKSFE
901 HKIYSKDLLH VLHSPFGYNT ARYKNLSIEA LFDKNESRPE VNPLSTNDGS G
```
FIG. 42F XxxCas13d (SEQ ID NO:1066)
```
   1 MKRQKTFAKR IGIKSTVAYG QGKYAITTFG KGSKAEIAVR SADPPEETLP TESDATLSIH
  61 AKFAKAGRDG REFKCGDVDE TRIHTSRSEY ESLISNPAES PREDYLGLKG TLERKFFGDE
 121 YPKDNLRIQI IYSILDIQKI LGLYVEDILH FVDGLQDEPE DLVGLGLGDE KMQKLLSKAL
 181 PYMGFFGSTD VFKVTKKREE RAAADEHNAK VFRALGAIRQ KLAHFKWKES LAIFGANANM
 241 PIRFFQGATG GRQLWNDVIA PLWKKRIERV RKSFLSNSAK NLWVLYQVFK DDTDEKKKAR
 301 ARQYYHFSVL KEGKNLGFNL TKTREYFLDK FFPIFHSSAP DVKRKVDTFR SKFYAILDFI
 361 IYEASVSVAN SGQMGKVAPW KGAIDNALVK LREAPDEEAK EKIYNVLAAS IRNDSLFLRL
 421 KSACDKFGAE QNRPVFPNEL RNNRDIRNVR SEWLEATQDV DAAAFVQLIA FLCNFLEGKE
 481 INELVTALIK KFEGIQALID LLRNLEGVDS IRFENEFALF NDDKGNMAGR IARQLRLLAS
 541 VGKMKPDMTD AKRVLYKSAL EILGAPPDEV SDEWLAENIL LDKSNNDYQK AKKTVNPFRN
 601 YIAKNVITSR SFYYLVRYAK PTAVRKLMSN PKIVRYVLKR LPEKQVASYY SAIWTQSESN
 661 SNEMVKLIEM IDRLTTEIAG FSFAVLKDKK DSIVSASRES RAVNLEVERL KKLTTLYMSI
 721 AYIAVKSLVK VNARYFIAYS ALERDLYFFN EKYGEEFRLH FIPYELNGKT CQFEYLAILK
 781 YYLARDEETL KRKCEICEEI KVGCEKHKKN ANPPYEYDQE WIDKKKALNS ERKACERRLH
 841 FSTHWAQYAT KRDENMAKHP QKWYDILASH YDELLALQAT GWLATQARND AEHLNPVNEF
 901 DVYIEDLRRY PEGTPKNKDY HIGSYFEIYH YIRQRAYLEE VLAKRKEYRD SGSFTDEQLD
 961 KLQKILDDIR ARGSYDKNLL KLEYLPFAYN LPRYKNLTTE ALFDDDSVSG KKRVAEWRER
1021 EKTREAEREQ RRQR
```

FIG. 42G

| Portion | Sequence (e.g., for use with EsiCas13d) | SEQ ID NO: |
|---|---|---|
| F | GAACUACACCCGUGC | 1070 |
| | GAACTACACCCGTGC | 1071 |
| | CACCCGUGC | 1072 |
| | CACCCGTGC | 1073 |
| L | AAAAAU | 1074 |
| | AAAAAT | 1075 |
| | AAAAA | 1076 |
| | AAAA | 1077 |
| E | GCAGGGGUCUAAAAC | 1078 |
| | GCAGGGGTCTAAAAC | 1079 |
| | GAACUACACCCGUGCAAAAAUGCAGGGGUCUAAAAC | 1080 |
| | GAACTACACCCGTGCAAAAATGCAGGGGTCTAAAAC | 1081 |
| | CACCCGUGCAAAAAUGCAGGGGUCUAAAAC | 1082 |
| | CACCCGTGCAAAAATGCAGGGGTCTAAAAC | 1083 |

FIG. 43A

| Portion | Sequence (e.g., for use with RfxCas13d) | SEQ ID NO: |
|---|---|---|
| F | CAAGUAAACCCCUAC | 1084 |
| | CAAGTAAACCCCTAC | 1085 |
| | UAAACCCCUAC | 1086 |
| | TAAACCCCTAC | 1087 |
| | AACCCCUAC | 1088 |
| | AACCCCTAC | 1089 |
| L | CAACUG | 1090 |
| | CAACTG | 1091 |
| E | GUCGGGGUUUGAAAC | 1092 |
| | GTCGGGGTTTGAAAC | 1093 |
| | GUCGGGGUU | 1094 |
| | GTCGGGGTT | 1095 |
| | CAAGUAAACCCCUACCAACUGGUCGGGGUUUGAAAC | 1096 |
| | CAAGTAAACCCCTACCAACTGGTCGGGGTTTGAAAC | 1097 |
| | UAAACCCCUACCAACUGGUCGGGGUUUGAAAC | 1098 |
| | TAAACCCCTACCAACTGGTCGGGGTTTGAAAC | 1099 |
| | AACCCCUACCAACUGGUCGGGGUUUGAAAC | 1100 |
| | AACCCCTACCAACTGGTCGGGGTTTGAAAC | 1101 |

FIG. 43B

| Portion | Sequence (e.g., for use with AdmCas13d) | SEQ ID NO: |
|---|---|---|
| F | GACCAACACCUCUGC | 1102 |
| | GACCAACACCTCTGC | 1103 |
| | CCAACACCUCUGC | 1104 |
| | CCAACACCTCTGC | 1105 |
| | CACCUCUGC | 1106 |
| | CACCTCTGC | 1107 |
| L | AAAACU | 1108 |
| | AAAACT | 1109 |
| | AAAA | 1110 |
| E | GCAGGGGUCUAAAAC | 1111 |
| | GCAGGGGTCTAAAAC | 1112 |
| | GCAGGGGUCUAA | 1113 |
| | GCAGGGGTCTAA | 1114 |
| | GACCAACACCUCUGCAAAACUGCAGGGGUCUAAAAC | 1115 |
| | GACCAACACCTCTGCAAAACTGCAGGGGTCTAAAAC | 1116 |
| | CACCUCUGCAAAACUGCAGGGGUCUAAAAC | 1117 |
| | CACCTCTGCAAAACTGCAGGGGTCTAAAAC | 1118 |

FIG. 43C

| Portion | Sequence (e.g., for use with XxxCas13d) | SEQ ID NO: |
|---|---|---|
| F | GUGAGAAGUCUCCU | 1119 |
| | GTGAGAAGTCTCCT | 1120 |
| | GUAGCAUCUCC | 1121 |
| | GTAGCATCTCC | 1122 |
| | GCUAGGGCUUGUAGGAA | 1123 |
| | GCTAGGGCTTGTAGGAA | 1124 |
| | AUUGUACCAUAGCAAGG | 1125 |
| | ATTGTACCATAGCAAGG | 1126 |
| L | UAUG | 1127 |
| | TATG | 1128 |
| | CCAUAA | 1129 |
| | CCATAA | 1130 |
| | UUCC | 1131 |
| | TTCC | 1132 |
| | AAUU | 1133 |
| | AATT | 1134 |
| E | GGGAGAUGCUAC | 1135 |
| | GGGAGATGCTAC | 1136 |
| | GGAGACUUCUCAC | 1137 |
| | GGAGACTTCTCAC | 1138 |
| | UUGCUAUGGUACAAU | 1139 |
| | TTGCTATGGTACAAT | 1140 |
| | CCUACAAGCCCUAGC | 1141 |
| | CCTACAAGCCCTAGC | 1142 |
| | GUGAGAAGUCUCCUUAUGGGGAGAUGCUAC | 1143 |
| | GTGAGAAGTCTCCTTATGGGGAGATGCTAC | 1144 |
| | GUAGCAUCUCCCCAUAAGGAGACUUCUCAC | 1145 |
| | GTAGCATCTCCCCATAAGGAGACTTCTCAC | 1146 |
| | GCUAGGGCUUGUAGGAA-UUCCUUGCUAUGGUACAAU | 1147 |
| | GCTAGGGCTTGTAGGAATTCCTTGCTATGGTACAAT | 1148 |
| | AUUGUACCAUAGCAAGGAAUUCCUACAAGCCCUAGC | 1149 |
| | ATTGTACCATAGCAAGGAATTCCTACAAGCCCTAGC | 1150 |

FIG. 43D

|  | Exemplary synthetic guiding components, F-L-E-(V)-(D) or E-(V) | SEQ ID NO: |
| --- | --- | --- |
| EsiCas13d | GAACUACACCCGUGC-AAAAAU-GCAGGGGUCUAAAAC-(V)-(D) | 1151 |
|  | GAACTACACCCGTGC-AAAAAT-GCAGGGGTCTAAAAC-(V)-(D) | 1152 |
|  | CACCCGUGC-AAAAAU-GCAGGGGUCUAAAAC-(V)-(D) | 1153 |
|  | CACCCGTGC-AAAAAT-GCAGGGGTCTAAAAC-(V)-(D) | 1154 |
| RfxCas13d | CAAGUAAACCCCUAC-CAACUG-GUCGGGGUUUGAAAC-(V)-(D) | 1155 |
|  | CAAGTAAACCCCTAC-CAACTG-GTCGGGGTTTGAAAC-(V)-(D) | 1156 |
|  | UAAACCCCUAC-CAACUG-GUCGGGGUUUGAAAC-(V)-(D) | 1157 |
|  | TAAACCCCTAC-CAACTG-GTCGGGGTTTGAAAC-(V)-(D) | 1158 |
|  | AACCCCUAC-CAACUG-GUCGGGGUUUGAAAC-(V)-(D) | 1159 |
|  | AACCCCTAC-CAACTG-GTCGGGGTTTGAAAC-(V)-(D) | 1160 |
| AdmCas13d | GACCAACACCUCUGC-AAAACU-GCAGGGGUCUAAAAC-(V)-(D) | 1161 |
|  | GACCAACACCTCTGC-AAAACT-GCAGGGGTCTAAAAC-(V)-(D) | 1162 |
|  | CACCUCUGC-AAAACU-GCAGGGGUCUAAAAC-(V)-(D) | 1163 |
|  | CACCTCTGC-AAAACT-GCAGGGGTCTAAAAC-(V)-(D) | 1164 |
| XxxCas13d | GUGAGAAGUCUCCU-UAUG-GGGAGAUGCUAC-(V)-(D) | 1165 |
|  | GTGAGAAGTCTCCT-TATG-GGGAGATGCTAC-(V)-(D) | 1166 |
|  | GUAGCAUCUCC-CCAUAA-GGAGACUUCUCAC-(V)-(D) | 1167 |
|  | GTAGCATCTCC-CCATAA-GGAGACTTCTCAC-(V)-(D) | 1168 |
|  | GCUAGGGCUUGUAGGAA-UUCC-UUGCUAUGGUACAAU-(V)-(D) | 1169 |
|  | GCTAGGGCTTGTAGGAA-TTCC-TTGCTATGGTACAAT-(V)-(D) | 1170 |
|  | AUUGUACCAUAGCAAGG-AAUU-CCUACAAGCCCUAGC-(V)-(D) | 1171 |
|  | ATTGTACCATAGCAAGG-AATT-CCTACAAGCCCTAGC-(V)-(D) | 1172 |

FIG. 44

```
Cas14a-1 (SEQ ID NO:1175)
   1 MEVQKTVMKT LSLRILRPLY SQEIEKEIKE EKERRKQAGG TGELDGGFYK KLEKKHSEMF
  61 SFDRLNLLLN QLQREIAKVY NHAISELYIA TIAQGNKSNK HYISSIVYNR AYGYFYNAYI
 121 ALGICSKVEA NFRSNELLTQ QSALPTAKSD NFPIVLHKQK GAEGEDGGFR ISTEGSDLIF
 181 EIPIPFYEYN GENRKEPYKW VKKGGQKPVL KLILSTFRRQ RNKGWAKDEG TDAEIRKVTE
 241 GKYQVSQIEI NRGKKLGEHQ KWFANFSIEQ PIYERKPNRS IVGGLDVGIR SPLVCAINNS
 301 FSRYSVDSND VFKFSKQVFA FRRRLLSKNS LKRKGHGAAH KLEPITEMTE KNDKFRKKII
 361 ERWAKEVTNF FVKNQVGIVQ IEDLSTMKDR EDHFFNQYLR GFWPYYQMQT LIENKLKEYG
 421 IEVKRVQAKY TSQLCSNPNC RYWNNYFNFE YRKVNKFPKF KCEKCNLEIS ADYNAARNLS
 481 TPDIEKFVAK ATKGINLPEK
```

FIG. 45A

```
Cas14a-2 (SEQ ID NO:1176)
   1 MEEAKTVSKT LSLRILRPLY SAEIEKEIKE EKERRKQGGK SGELDSGFYK KLEKKHTQMF
  61 GWDKLNLMLS QLQRQIARVF NQSISELYIE TVIQGKKSNK HYTSKIVYNR AYSVFYNAYL
 121 ALGITSKVEA NFRSTELLMQ KSSLPTAKSD NFPILLHKQK GVEGEEGGFK ISADGNDLIF
 181 EIPIPFYEYD SANKKEPFKW IKKGGQKPTI KLILSTFRRQ RNKGWAKDEG TDAEIRKVIE
 241 GKYQVSHIEI NRGKKLGDHQ KWFVNFTIEQ PIYERKLDKN IIGGIDVGIK SPLVCAVNNS
 301 FARYSVDSND VLKFSKQAFA FRRRLLSKNS LKRSGHGSKN KLDPITRMTE KNDRFRKKII
 361 ERWAKEVTNF FIKNQVGTVQ IEDLSTMKDR QDNFFNQYLR GFWPYYQMQN LIENKLKEYG
 421 IETKRIKARY TSQLCSNPSC RHWNSYFSFD HRKTNNFPKF KCEKCALEIS ADYNAARNIS
 481 TPDIEKFVAK ATKGINLPDK NENVILE
```

FIG. 45B

Cas14a-3 (SEQ ID NO:1177)
```
  1 MAKNTITKTL KLRIVRPYNS AEVEKIVADE KNNREKIALE KNKDKVKEAC SKHLKVAAYC
 61 TTQVERNACL FCKARKLDDK FYQKLRGQFP DAVFWQEISE IFRQLQKQAA EIYNQSLIEL
121 YYEIFIKGKG IANASSVEHY LSDVCYTRAA ELFKNAAIAS GLRSKIKSNF RLKELKNMKS
181 GLPTTKSDNF PIPLVKQKGG QYTGFEISNH NSDFIIKIPF GRWQVKKEID KYRPWEKFDF
241 EQVQKSPKPI SLLLSTQRRK RNKGWSKDEG TEAEIKKVMN GDYQTSYIEV KRGSKIGEKS
301 AWMLNLSIDV PKIDKGVDPS IIGGIDVGVK SPLVCAINNA FSRYSISDND LFHFNKKMFA
361 RRRILLKKNR HKRAGHGAKN KLKPITILTE KSERFRKKLI ERWACEIADF FIKNKVGTVQ
421 MENLESMKRK EDSYFNIRLR GFWPYAEMQN KIEFKLQYG  IEIRKVAPNN TSKTCSKCGH
481 LNNYFNFEYR KKNKFPHFKC EKCNFKENAD YNAALNISNP KLKSTKEEP
```

FIG. 45C

| Portion | Sequence (e.g., for use with Cas14a) | SEQ ID NO: |
|---|---|---|
| F | CUUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUGCUUUCUUCGGAAAGUAACCCUCGAAACAAAUUCAUUU | 1180 |
| | CTTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGCTTTCTTCGGAAAGTAACCCTCGAAACAAATTCATTT | 1181 |
| | CUUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUGCUUUCUUCGGAAAGUAACCCUCGAAACAAAUUCAUUUUUC | 1182 |
| | CTTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGCTTTCTTCGGAAAGTAACCCTCGAAACAAATTCATTTTTC | 1183 |
| | CUUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUGCUUUCUUCGGAAAGUAACCCUCGAAACAAAUUCAUUUUUCCUCUCCAAUUCUGCACAA | 1184 |
| | CTTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGCTTTCTTCGGAAAGTAACCCTCGAAACAAATTCATTTTTCCTCTCCAATTCTGCACAA | 1185 |
| | UUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUGCUUUCUUCGGAAAGUAACCCUCGAAACAAAUUCAUUU | 1186 |
| | TTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGCTTTCTTCGGAAAGTAACCCTCGAAACAAATTCATTT | 1187 |
| | UUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUGCUUUCUUCGGAAAGUAACCCUCGAAACAAAUUCAUUUUUC | 1188 |
| | TTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGCTTTCTTCGGAAAGTAACCCTCGAAACAAATTCATTTTTC | 1189 |
| | UUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUGCUUUCUUCGGAAAGUAACCCUCGAAACAAAUUCAUUU | 1190 |
| | TTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGCTTTCTTCGGAAAGTAACCCTCGAAACAAATTCATTT | 1191 |
| L | GAAA | 1192 |
| | AAAA | 1193 |
| E | GAAUGAAGGAAUGCAAC | 1194 |
| | GAATGAAGGAATGCAAC | 1195 |
| | GACGAAUGAAGGAAUGCAAC | 1196 |
| | GACGAATGAAGGAATGCAAC | 1197 |
| | GUUGCAGAACCCGAAUAGACGAAUGAAGGAAUGCAAC | 1198 |
| | GTTGCAGAACCCGAATAGACGAATGAAGGAATGCAAC | 1199 |

FIG. 46

| | Exemplary synthetic guiding components, F-L-E-(V)-(D) | SEQ ID NO: |
|---|---|---|
| Cas14a | CTTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTG CTTTCTTCGGAAAGTAACCCTCGAAACAAATTCATTT-AAAA-GAATGAAGGAATGCAAC-(V)-(D) | 1200 |
| | CUUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUG CUUUCUUCGGAAAGUAACCCUCGAAACAAAUUCAUUU-AAAA-GAAUGAAGGAAUGCAAC-(V)-(D) | 1201 |
| | CTTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTG CTTTCTTCGGAAAGTAACCCTCGAAACAAATTCATTT-GAAA-GAATGAAGGAATGCAAC-(V)-(D) | 1202 |
| | CUUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUG CUUUCUUCGGAAAGUAACCCUCGAAACAAAUUCAUUU-GAAA-GAAUGAAGGAAUGCAAC-(V)-(D) | 1203 |
| | CTTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTG CTTTCTTCGGAAAGTAACCCTCGAAACAAATTCATTTTC-AAAA-GACGAATGAAGGAATGCAAC-(V)-(D) | 1204 |
| | CUUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUG CUUUCUUCGGAAAGUAACCCUCGAAACAAAUUCAUUUUC-AAAA-GACGAAUGAAGGAAUGCAAC-(V)-(D) | 1205 |
| | CTTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTG CTTTCTTCGGAAAGTAACCCTCGAAACAAATTCATTTTC-GAAA-GACGAATGAAGGAATGCAAC-(V)-(D) | 1206 |
| | CUUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUG CUUUCUUCGGAAAGUAACCCUCGAAACAAAUUCAUUUUC-GAAA-GACGAAUGAAGGAAUGCAAC-(V)-(D) | 1207 |
| | CTTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTG CTTTCTTCGGAAAGTAACCCTCGAAACAAATTCATTT-AAAAA-GTTGCAGAACCGAATAGACGAATGAAGGAATGCAAC-(V)-(D) | 1208 |
| | CUUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUG CUUUCUUCGGAAAGUAACCCUCGAAACAAAUUCAUUU-AAAAA-GUUGCAGAACCGAAUAGACGAAUGAAGGAAUGCAAC-(V)-(D) | 1209 |
| | CTTCACTGATAAAGTGTCCAAAAGCTGTCCCTTAGGGATTAGAACTTGAGTGAAGGTGGGCTGCTTGCATCAGCCTAATGTCGAGAAGTG CTTTCTTCGGAAAGTAACCCTCGAAACAAATTCATTTTCCTCTCCAATTCTGCACAA-GAAA-GTTGCAGAACCGAATAGACGAATGAAGGAATGCAAC-(V)-(D) | 1210 |
| | CUUCACUGAUAAAGUGUCCAAAAGCUGUCCCUUAGGGAUUAGAACUUGAGUGAAGGUGGGCUGCUUGCAUCAGCCUAAUGUCGAGAAGUG CUUUCUUCGGAAAGUAACCCUCGAAACAAAUUCAUUUUCCUCUCCAAUUCUGCACAA-GAAA-GUUGCAGAACCGAAUAGACGAAUGAAGGAAUGCAAC-(V)-(D) | 1211 |
| | TTCACTGATAAAGTGGAGAACCGCTTCACCAAAAGCTGTCCCTTAGGGGATTAGAACTTGAGTTGCATCAGCCTAATGTCGAGAAGTGC TTTCTTCGGAAAGTAACCCTCGAAACAAATTCATTT-AAAA-GAATGAAGGAATGCAAC-(V)-(D) | 1212 |
| | UUCACUGAUAAAGUGGAGAACCGCUUCACCAAAAGCUGUCCCUUAGGGGAUUAGAACUUGAGUUGCAUCAGCCUAAUGUCGAGAAGUGC UUUCUUCGGAAAGUAACCCUCGAAACAAAUUCAUUU-AAAA-GAAUGAAGGAAUGCAAC-(V)-(D) | 1213 |
| | TTCACTGATAAAGTGGAGAACCGCTTCACCAAAAGCTGTCCCTTAGGGGATTAGAACTTGAGTTGCATCAGCCTAATGTCGAGAAGTGC TTTCTTCGGAAAGTAACCCTCGAAACAAATTCATTT-GAAA-GAATGAAGGAATGCAAC-(V)-(D) | 1214 |

FIG. 47A

| | Exemplary synthetic guiding components, F-L-E-(V)-(D) | SEQ ID NO: |
|---|---|---|
| | UUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUGC UUUCUUCGGAAAGUAACCCUCGAAACAAAUUCAUUU-GAAA-GAAUGAAGGAAUGCAAC-(V)-(D) | 1215 |
| | TTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGC TTTCTTCGGAAAGTAACCCTCGAAACAAATTCATTTTTC-AAAA-GACGAATGAAGGAATGCAAC-(V)-(D) | 1216 |
| | UUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUGC UUUCUUCGGAAAGUAACCCUCGAAACAAAUUCAUUUUUC-AAAA-GACGAAUGAAGGAAUGCAAC-(V)-(D) | 1217 |
| | TTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGC TTTCTTCGGAAAGTAACCCTCGAAACAAATTCATTTTTC-GAAA-GACGAATGAAGGAATGCAAC-(V)-(D) | 1218 |
| | UUCACUGAUAAAGUGGAGAACCGCUUCACCAAAAGCUGUCCCUUAGGGGAUUAGAACUUGAGUGAAGGUGGGCUGCUUGCAUCAGCCUAAUGUCGAGAAGUGC UUUCUUCGGAAAGUAACCCUCGAAACAAAUUCAUUUUUC-GAAA-GACGAAUGAAGGAAUGCAAC-(V)-(D) | 1219 |

FIG. 47B

CRISPR/CAS ACTIVITY ASSAYS AND COMPOSITIONS THEREOF

CROSS-REFERENCE TO RELATED APPLICATION

This application claims the benefit of U.S. Provisional Application No. 62/646,780, filed Mar. 22, 2018, which is hereby incorporated by reference in its entirety.

STATEMENT OF GOVERNMENT INTEREST

This invention was made with Government support under Contract No. DE-NA0003525 awarded by the United States Department of Energy/National Nuclear Security Administration. The Government has certain rights in the invention.

REFERENCE TO A SEQUENCE LISTING APPENDIX

A sequence listing appendix including an ASCII formatted file accompanies this application. The appendix includes a file named "SD14418_1_ST25.txt," created on Aug. 12, 2019 (size of 799 kilobytes), which is hereby incorporated by reference in its entirety.

FIELD OF THE INVENTION

The present invention relates, in part, to methods for detecting nuclease activity, such as the activity of Cas nucleases. Also described herein are compositions for conducting assays, as well as methods for conducting assays in the presence of test compounds.

BACKGROUND OF THE INVENTION

CRISPR-Cas based systems have emerged as a promising methodology for gene editing. Targeted editing will require further understanding of various components of this system, such as the Cas protein. In addition, it may be beneficial to understand what compounds interact with the Cas protein, which may impact its efficacy. Such biochemical studies would benefit from high-throughput assays. Accordingly, there is a need for synthetic substrates and assay methods to further characterize Cas proteins.

SUMMARY OF THE INVENTION

The present invention relates, in part, to methods and compositions useful for detecting nuclease activity (e.g., Cas protein activity). Described herein are cleavage substrates designed to emit a detectable signal upon being cleaved by a Cas protein. In an exemplary embodiment, the cleavage substrate is a duplex including two oligonucleotide strands, in which a first strand includes a fluorophore label and a second strand includes a quencher label. The fluorophore and the quencher form a Forster resonance energy transfer (FRET) pair, in which the two labels are in close proximity within the duplex, such that fluorescence emission is quenched. Upon cleavage of the duplex substrate, the distance between the two labels is increased, thereby allowing for a quantitative increase in fluorescence signal based on extent of nuclease activity. In particular embodiments, use of the substrates herein allow for the quantitative monitoring of Cas9 cleavage activity by fluorescence spectroscopy in a high-throughput microplate format. Additional details follow.

Accordingly, in a first aspect, the present invention features a method for detecting nuclease activity, the method including: combining a target nuclease with a cleavage substrate and a synthetic guiding component, thereby providing a reaction mixture; incubating the reaction mixture, thereby providing an incubated reaction mixture; and quenching the incubated reaction mixture under a denaturation condition configured to denature the target nuclease. In particular embodiments, the present invention also includes: measuring a detectable signal, if any, arising from a reacted cleavage substrate.

In some embodiments, the cleavage substrate includes a duplex having a target strand and a non-target strand, and where at least one of the target or non-target strand includes a detectable label.

In some embodiments, the target strand includes a structure having formula (Ia) of 5'-X-Y-T-Z-3' or formula (Ib) of 5'-Z-T-Y-X-3' or a salt thereof, where: X is a first binding region including a nucleic acid sequence, Y is a protospacer adjacent motif-binding region including a nucleic acid sequence configured to bind to a protospacer adjacent motif in the non-target strand, T is a target site including a nucleic acid sequence configured to bind to a targeting portion of the synthetic guiding component, and Z is a second binding region including a nucleic acid sequence.

In some embodiments, the non-target strand includes a structure having formula (IIa) of 5'-A-U-B-C-3' or formula (IIb) of 5'-C-B-U-A-3' or a salt thereof, where: A is a third binding region including a nucleic acid sequence configured to bind to Z or a portion thereof, U is a complementary target site including a nucleic acid sequence configured to bind T or a portion thereof, B is the protospacer adjacent motif configured to interact with the target nuclease, and C is a fourth binding region including a nucleic acid sequence configured to bind X or a portion thereof.

In some embodiments, X has a length of from 2 to about 40 nucleotides, Y has a length of from about 0 to 10 nucleotides, T has a length of from about 10 to about 30 nucleotides, Z has a length of from about 10 to about 40 nucleotides, A has a length of from about 10 to about 40 nucleotides, U has a length of from about 10 to about 30 nucleotides, B has a length of from about 0 to 10 nucleotides, and C has a length of from 1 to about 40 nucleotides. In other embodiments, X is longer than C.

In some embodiments, the target strand includes a nucleic acid sequence having at least 80% sequence identity to any one of SEQ ID NOs: 1, 3, 5, 7, and 388-399 or a complement of any of these, or a fragment thereof.

In some embodiments, X includes a nucleic acid sequence having at least 80% sequence identity to any one of SEQ ID NOs: 20-30, or a complement of any of these, or a fragment thereof; Y includes a nucleic acid sequence having at least 80% sequence identity to any one of SEQ ID NOs: 31-33, or a complement of any of these, or a fragment thereof; and Z includes a nucleic acid sequence having at least 80% sequence identity to any one of SEQ ID NOs: 34-38, or a complement of any of these, or a fragment thereof.

In some embodiments, the non-target strand includes a nucleic acid sequence having at least 80% sequence identity to any one of SEQ ID NOs: 2, 4, 6, 8, and 400-417 or a complement of any of these, or a fragment thereof.

In some embodiments, A includes a nucleic acid sequence having at least 80% sequence identity to any one of SEQ ID NOs: 39-43, or a complement of any of these, or a fragment thereof; B includes a nucleic acid sequence having at least 80% sequence identity to any one of SEQ ID NOs: 44-46, or a complement of any of these, or a fragment thereof, and C includes a nucleic acid sequence having at least 80% sequence identity to any one of SEQ ID NOs: 47-58, or a complement of any of these, or a fragment thereof.

In some embodiments, the target strand includes a fluorescent label at the 5'-end and where the non-target strand includes a quencher label at the 3'-end. In other embodiments, the target strand does not include the detectable label, and where the non-target strand includes an internal fluorescent label, an optional internal quencher label, and a quencher label at the 3'-end.

In some embodiments, the synthetic guiding component is configured to interact with the target nuclease, and where the cleavage substrate is configured to interact with the synthetic guiding component.

In some embodiments, the synthetic guiding component includes a structure having formula (IIIa) of 5'-D-V-E-L-F-3' or formula (IIIb) of 5'-F-L-E-V-D-3' or a salt thereof, where: D is an optional third portion including a nucleic acid sequence of from about 1 to 20 nucleic acids; V is a targeting portion including a nucleic acid sequence configured to bind to a target site of the cleavage substrate; E is a first portion including a nucleic acid sequence configured to interact with a nuclease configured to bind and/or cleave the cleavage substrate; L is a linker; and F is a second portion including a nucleic acid sequence configured to interact with the target nuclease and E or a portion thereof.

In other embodiments, the synthetic guiding component includes a nucleic acid sequence having at least 80% sequence identity to any one of SEQ ID NOs: 9-12, 350-387, 537-564, 672-699, 801-814, 879-902, 982-1003, 1047-1056, 1151-1172, and 1200-1219 or a complement of any of these, or a fragment thereof.

In some embodiments, D has a length of from 0 to about 20 nucleotides, V has a length of from about 10 to about 30 nucleotides, E has a length of from about 10 to about 40 nucleotides, L has a length of from 0 to about 10 nucleotides, and/or F has a length of from about 10 to about 100 nucleotides.

In some embodiments, E includes a nucleic acid sequence having at least 80% sequence identity to any one of SEQ ID NOs: 150-159, 184-189, 213-220, 249-264, 282-287, 308-311, 331-336, 445-462, 485-496, 520-535, 610-627, 640-645, 664-671, 716-721, 729-734, 740-745, 753-756, 765-770, 779-784, 795-800, 845-852, 861-862, 871-878, 923-931, 940-946, 958-968, 975-981, 1010-1017, 1027-1038, 1078-1083, 1092-1101, 1111-1118, 1135-1150, and 1194-1199 or a complement of any of these, or a fragment thereof.

In some embodiments, L includes a nucleic acid sequence having at least 80% sequence identity to any one of SEQ ID NOs: 160-165, 190-195, 221-227, 265-270, 288-294, 312-317, 337-341, 435-444, 475-484, 508-519, 595-609, 634-639, 658-663, 713-715, 726-728, 737-739, 749-752, 761-764, 775-778, 791-794, 841-844, 857-860, 867-870, 919-922, 937-939, 955-957, 972-974, 1018-1022, 1039-1042, 1074-1077, 1090-1091, 1108-1110, 1127-1134, and 1192-1193 or a complement of any of these, or a fragment thereof.

In some embodiments, F includes a nucleic acid sequence having at least 80% sequence identity to any one of SEQ ID NOs:166-183, 196-212, 228-248, 271-281, 295-307, 318-330, 342-349, 425-434, 463-474, 498-507, 580-594, 628-633, 646-657, 710-712, 722-725, 735-736, 746-748, 757-760, 771-774, 785-790, 825-840, 853-856, 863-866, 915-918, 932-936, 947-954, 969-971, 1023-1026, 1043-1046, 1070-1073, 1084-1089, 1102-1107, 1119-1126, and 1180-1191 or a complement of any of these, or a fragment thereof.

In some embodiments, the target nuclease is a Cas protein or a modified form thereof. In some embodiments, the target nuclease includes an amino acid sequence having at least 80% sequence identity to any one of SEQ ID NOs:100-105, 110-126, 420-422, 570-573, 700-707, 820-822, 910-913, 1005-1006, 1060-1066, and 1175-1177, or a fragment thereof.

In some embodiments, the reaction mixture further includes a nuclease buffer, blood, plasma, a biological fluid, an organism, and/or a cell.

In some embodiments, the incubating step occurs at an ambient temperature.

In some embodiments, the denaturation condition includes an elevated temperature of from about 60° C. to about 100° C. In other embodiments, the denaturation condition includes formamide, urea, guanidine, sodium dodecyl sulfate, or a salt thereof.

In a second aspect, the present invention features a method for testing a drug for nuclease activity, the method including: combining a target nuclease (e.g., any herein) with a cleavage substrate (e.g., any herein) and a synthetic guiding component (e.g., any herein), thereby providing a reaction mixture; introducing one or more drugs to the reaction mixture; incubating the reaction mixture, thereby providing an incubated reaction mixture; quenching the incubated reaction mixture under a denaturation condition configured to denature the target nuclease; and measuring a detectable signal, if any, arising from a reacted cleavage substrate, thereby determining whether the drug inhibits or activates the target nuclease.

In a third aspect, the present invention features a cleavage substrate including a duplex having a target strand and a non-target strand, where: the target strand includes a structure having formula (Ia) of 5'-X-Y-T-Z-3' or formula (Ib) of 5'-Z-T-Y-X-3' or a salt thereof and includes a first detectable label, where: X is a first binding region including a nucleic acid sequence, Y is a protospacer adjacent motif-binding region including a nucleic acid sequence configured to bind to a protospacer adjacent motif in the non-target strand, T is a target site including a nucleic acid sequence configured to bind to a targeting portion of the synthetic guiding component, and Z is a second binding region including a nucleic acid sequence; and the non-target strand includes a structure having formula (IIa) of 5'-A-U-B-C-3' or formula (IIb) of 5'-C-B-U-A-3' or a salt thereof, and includes a second detectable label, where: A is a third binding region including a nucleic acid sequence configured to bind to Z or a portion thereof, U is a complementary target site including a nucleic acid sequence configured to bind T or a portion thereof, B is the protospacer adjacent motif configured to interact with the target nuclease, and C is a second binding region including a nucleic acid sequence configured to bind X or a portion thereof, where the first detectable label is located in proximity to the second detectable label.

In a fourth aspect, the present invention features a cleavage substrate including a duplex having a target strand and a non-target strand, where: the target strand includes a structure having formula (Ia) of 5'-X-Y-T-Z-3' or formula (Ib) of 5'-Z-T-Y-X-3' or a salt thereof, where: X is a first binding region including a nucleic acid sequence, Y is a protospacer adjacent motif-binding region including a nucleic acid sequence configured to bind to a protospacer adjacent motif in the non-target strand, T is a target site including a nucleic acid sequence configured to bind to a targeting portion of the synthetic guiding component, and Z is a second binding region including a nucleic acid sequence; and the non-target strand includes a structure having formula (IIa) of 5'-A-U-B-C-3' or formula (IIb) of 5'-C-B-U-A-3' or a salt thereof, and includes a first detectable label and a second detectable label, where: A is a third binding region including a nucleic acid sequence configured to bind to Z or a portion thereof, U is a complementary target site including a nucleic acid sequence configured to bind T or a portion thereof, B is the protospacer adjacent motif configured to interact with the target nuclease, and C is a second binding region including a nucleic acid sequence configured to bind X or a portion thereof, where the first detectable label is located in proximity to the second detectable label.

In some embodiments, X and/or C has a length of from 1 to about 40 nucleotides (e.g., of from about 1 to 2, 1 to 3, 1 to 4, 1 to 5, 1 to 6, 1 to 7, 1 to 8, 1 to 9, 1 to 10, 1 to 11, 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 29, 1 to 30, 1 to 35, 1 to 35, 2 to 3, 2 to 4, 2 to 5, 2 to 6, 2 to 7, 2 to 8, 2 to 9, 2 to 10, 2 to 11, 2 to 12, 2 to 13, 2 to 14, 2 to 15, 2 to 16, 2 to 17, 2 to 18, 2 to 19, 2 to 20, 2 to 21, 2 to 22, 2 to 23, 2 to 24, 2 to 25, 2 to 26, 2 to 27, 2 to 28, 2 to 29, 2 to 30, 2 to 35, 2 to 35, 2 to 40, 3 to 4, 3 to 5, 3 to 6, 3 to 7, 3 to 8, 3 to 9, 3 to 10, 3 to 11, 3 to 12, 3 to 13, 3 to 14, 3 to 15, 3 to 16, 3 to 17, 3 to 18, 3 to 19, 3 to 20, 3 to 21, 3 to 22, 3 to 23, 3 to 24, 3 to 25, 3 to 26, 3 to 27, 3 to 28, 3 to 29, 3 to 30, 3 to 35, 3 to 35, 3 to 40, 4 to 5, 4 to 6, 4 to 7, 4 to 8, 4 to 9, 4 to 10, 4 to 11, 4 to 12, 4 to 13, 4 to 14, 4 to 15, 4 to 16, 4 to 17, 4 to 18, 4 to 19, 4 to 20, 4 to 21, 4 to 22, 4 to 23, 4 to 24, 4 to 25, 4 to 26, 4 to 27, 4 to 28, 4 to 29, 4 to 30, 4 to 35, 4 to 35, 4 to 40, 6 to 7, 6 to 8, 6 to 9, 6 to 10, 6 to 11, 6 to 12, 6 to 13, 6 to 14, 6 to 15, 6 to 16, 6 to 17, 6 to 18, 6 to 19, 6 to 20, 6 to 21, 6 to 22, 6 to 23, 6 to 24, 6 to 25, 6 to 26, 6 to 27, 6 to 28, 6 to 29, 6 to 30, 6 to 35, 6 to 35, 6 to 40, 8 to 9, 8 to 10, 8 to 11, 8 to 12, 8 to 13, 8 to 14, 8 to 15, 8 to 16, 8 to 17, 8 to 18, 8 to 19, 8 to 20, 8 to 21, 8 to 22, 8 to 23, 8 to 24, 8 to 25, 8 to 26, 8 to 27, 8 to 28, 8 to 29, 8 to 30, 8 to 35, 8 to 35, 8 to 40, 10 to 11, 10 to 12, 10 to 13, 10 to 14, 10 to 15, 10 to 16, 10 to 17, 10 to 18, 10 to 19, 10 to 20, 10 to 21, 10 to 22, 10 to 23, 10 to 24, 10 to 25, 10 to 26, 10 to 27, 10 to 28, 10 to 29, 10 to 30, 10 to 35, 10 to 40, 11 to 15, 11 to 16, 11 to 17, 11 to 18, 11 to 19, 11 to 20, 11 to 21, 11 to 22, 11 to 23, 11 to 24, 11 to 25, 11 to 26, 11 to 27, 11 to 28, 11 to 29, 11 to 30, 11 to 35, 11 to 40, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 12 to 35, 12 to 40, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 13 to 35, 13 to 40, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 14 to 35, 14 to 40, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 15 to 35, 15 to 40, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 16 to 35, 16 to 40, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 17 to 35, 17 to 40, 18 to 19, 18 to 20, 18 to 21, 18 to 22, 18 to 23, 18 to 24, 18 to 25, 18 to 26, 18 to 27, 18 to 28, 18 to 29, 18 to 30, 18 to 35, 18 to 40, 19 to 20, 19 to 21, 19 to 22, 19 to 23, 19 to 24, 19 to 25, 19 to 26, 19 to 27, 19 to 28, 19 to 29, 19 to 30, 19 to 35, 19 to 40, 20 to 21, 20 to 22, 20 to 23, 20 to 24, 20 to 25, 20 to 26, 20 to 27, 20 to 28, 20 to 29, 20 to 30, 20 to 35, 20 to 40, 21 to 22, 21 to 23, 21 to 24, 21 to 25, 21 to 26, 21 to 27, 21 to 28, 21 to 29, 21 to 30, 21 to 35, 21 to 40, 22 to 23, 22 to 24, 22 to 25, 22 to 26, 22 to 27, 22 to 28, 22 to 29, 22 to 30, 22 to 35, 22 to 40, 23 to 24, 23 to 25, 23 to 26, 23 to 27, 23 to 28, 23 to 29, 23 to 30, 23 to 35, 23 to 40, 24 to 25, 24 to 26, 24 to 27, 24 to 28, 24 to 29, 24 to 30, 24 to 35, 24 to 40, 25 to 26, 25 to 27, 25 to 28, 25 to 29, 25 to 30, 25 to 35, 25 to 40, 26 to 27, 26 to 28, 26 to 29, 26 to 30, 26 to 35, 26 to 40, 27 to 28, 27 to 29, 27 to 30, 28 to 29, 28 to 30, 28 to 35, 28 to 40, 29 to 30, 29 to 35, 29 to 40, 30 to 35, 30 to 40, or 35 to 40 nucleotides).

In some embodiments, Y and/or B has a length of from 0 to about 20 nucleotides (e.g., of from about 0 to 4, 0 to 5, 0 to 6, 0 to 7, 0 to 8, 0 to 9, 0 to 10, 0 to 15, 1 to 4, 1 to 5, 1 to 6, 1 to 7, 1 to 8, 1 to 9, 1 to 10, 1 to 5, 1 to 20, 2 to 4, 2 to 5, 2 to 6, 2 to 7, 2 to 8, 2 to 9, 2 to 10, 2 to 15, 2 to 20, 3 to 4, 3 to 5, 3 to 6, 3 to 7, 3 to 8, 3 to 9, 3 to 10, 3 to 15, 3 to 20, 4 to 5, 4 to 6, 4 to 7, 4 to 8, 4 to 9, 4 to 10, 4 to 15, 4 to 20, 5 to 6, 5 to 7, 5 to 8, 5 to 9, 5 to 10, 5 to 5, 5 to 20, 10 to 15, 10 to 20, or 15 to 20 nucleotides, and optionally including one or more modified nucleotides, such as any described herein).

In some embodiments, D has a length of from 0 to about 20 nucleotides (e.g., of from about 0 to 4, 0 to 5, 0 to 6, 0 to 7, 0 to 8, 0 to 9, 0 to 10, 0 to 15, 1 to 4, 1 to 5, 1 to 6, 1 to 7, 1 to 8, 1 to 9, 1 to 10, 1 to 5, 1 to 20, 2 to 4, 2 to 5, 2 to 6, 2 to 7, 2 to 8, 2 to 9, 2 to 10, 2 to 15, 2 to 20, 3 to 4, 3 to 5, 3 to 6, 3 to 7, 3 to 8, 3 to 9, 3 to 10, 3 to 15, 3 to 20, 4 to 5, 4 to 6, 4 to 7, 4 to 8, 4 to 9, 4 to 10, 4 to 15, 4 to 20, 5 to 6, 5 to 7, 5 to 8, 5 to 9, 5 to 10, 5 to 5, 5 to 20, 10 to 5, 10 to 20, or 15 to 20 nucleotides, and optionally including one or more modified nucleotides, such as any described herein).

In some embodiments, V is configured to bind to the target site of a target strand derived from a human RNA target sequence or a pathogen target sequence (e.g., a viral sequence).

In some embodiments, T, Z, A, U, and/or V has a length of from about 10 to about 40 nucleotides (e.g., of from about 10 to 11, 10 to 12, 10 to 13, 10 to 14, 10 to 15, 10 to 16, 10 to 17, 10 to 18, 10 to 19, 10 to 20, 10 to 21, 10 to 22, 10 to 23, 10 to 24, 10 to 25, 10 to 26, 10 to 27, 10 to 28, 10 to 29, 10 to 30, 10 to 35, 11 to 5, 11 to 6, 11 to 7, 11 to 8, 11 to 9, 11 to 20, 11 to 21, 11 to 22, 11 to 23, 11 to 24, 11 to 25, 11 to 26, 11 to 27, 11 to 28, 11 to 29, 11 to 30, 11 to 35, 11 to 40, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 12 to 35, 12 to 40, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 13 to 35, 13 to 40, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 14 to 35, 14 to 40, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 15 to 35, 15 to 40, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 16 to 35, 16 to 40, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 17 to 35, 17 to 40, 18 to 19, 18 to 20, 18 to 21, 18 to 22, 18 to 23, 18 to 24, 18 to 25, 18 to 26, 18 to 27, 18 to 28, 18 to 29, 18 to 30, 18 to 35, 18 to 40, 19 to 20, 19 to 21, 19 to 22, 19 to 23, 19 to 24, 19 to 25, 19 to 26, 19 to 27, 19 to 28, 19 to 29, 19 to 30, 19 to 35, 19 to 40, 20 to 21, 20 to 22, 20 to 23, 20 to 24, 20 to 25, 20 to 26, 20 to 27, 20 to 28, 20 to 29, 20 to 30, 20 to 35, 20 to 40, 21 to 22, 21 to 23, 21 to 24, 21 to 25, 21 to 26, 21 to 27, 21 to 28, 21 to 29, 21 to 30, 21 to 35, 21 to 40, 22 to 23, 22 to 24, 22 to 25, 22 to 26, 22 to 27, 22 to 28, 22 to 29, 22 to 30, 22 to 35, 22 to 40, 23 to 24, 23 to 25, 23 to 26, 23 to 27, 23 to 28, 23 to 29, 23 to 30, 23 to 35, 23 to 40, 24 to 25, 24 to 26, 24 to 27, 24 to 28, 24 to 29, 24 to 30, 24 to 35, 24 to 40, 25 to 26, 25 to 27, 25 to 28, 25 to 29, 25 to 30, 25 to 35, 25 to 40, 26 to 27, 26 to 28, 26 to 29, 26 to 30, 26 to 35, 26 to 40, 27 to 28, 27 to 29, 27 to 30, 28 to 29, 28 to 30, 28 to 35, 28 to 40, 29 to 30, 29 to 35, 29 to 40, 30 to 35, 30 to 40, or 35 to 40 nucleotides).

In some embodiments, E has a length of from about 10 to about 50 nucleotides (e.g., of from about 10 to 20, 10 to 25, 10 to 30, 10 to 35, 10 to 40, 10 to 45, 15 to 20, 15 to 25, 15 to 30, 15 to 35, 15 to 40, 15 to 45, 15 to 50, 20 to 25, 20 to 30, 20 to 35, 20 to 40, 20 to 45, 20 to 50, 25 to 30, 25 to 35, 25 to 40, 25 to 45, 25 to 50, 30 to 35, 30 to 40, 30 to 45, 30 to 50, 35 to 40, 35 to 45, 35 to 50, 40 to 45, 40 to 50, or 45 to 50 nucleotides, and optionally including one or more modified nucleotides, such as any described herein).

In some embodiments, L has a length of from 0 to about 15 nucleotides (e.g., L is a bond, an $C_{1-10}$ alkylene, a $C_{1-10}$ heteroalkylene, or has a length of from about 0 to 10 nucleotides, such as 0 to 2, 0 to 4, 0 to 6, 0 to 8, 0 to 10, 0 to 15, 2 to 4, 2 to 6, 2 to 8, 2 to 10, 2 to 15, 4 to 6, 4 to 8, 4 to 10, 4 to 15, 6 to 8, 6 to 10, 6 to 15, 8 to 10, 8 to 15, 10 to 15, or 13 to 15 nucleotides).

In some embodiments, F has a length of from about 10 to about 100 nucleotides (e.g., of from about 10 to 20, 10 to 30, 10 to 40, 10 to 50, 10 to 60, 10 to 70, 10 to 80, 10 to 90, 20 to 30, 20 to 40, 20 to 50, 20 to 60, 20 to 70, 20 to 80, 20 to 90, 20 to 100, 30 to 40, 30 to 50, 30 to 60, 30 to 70, 30 to 80, 30 to 90, 30 to 100, 40 to 50, 40 to 60, 40 to 70, 40 to 80, 40 to 90, 40 to 100, 50 to 60, 50 to 70, 50 to 80, 50 to 90, 50 to 100, 60 to 70, 60 to 80, 60 to 90, 60 to 100, 70 to 80, 70 to 90, 70 to 100, 80 to 90, 80 to 100, or 90 to 100 nucleotides).

In any embodiment herein, the synthetic guiding construct has a length of from about 80 to about 300 nucleotides (e.g., of from about 80 to 90, 80 to 100, 80 to 125, 80 to 150, 80 to 175, 80 to 200, 80 to 225, 80 to 250, 80 to 275, 90 to 100, 90 to 125, 90 to 150, 90 to 175, 90 to 200, 90 to 225, 90 to 250, 90 to 275, 90 to 300, 100 to 125, 100 to 150, 100 to 175, 100 to 200, 100 to 225, 100 to 250, 100 to 275, 100 to 300, 125 to 150, 125 to 175, 125 to 200, 125 to 225, 125 to 250, 125 to 275, 125 to 300, 150 to 175, 150 to 200, 150 to 225, 150 to 250, 150 to 275, 150 to 300, 175 to 200, 175 to 225, 175 to 250, 175 to 275, 175 to 300, 200 to 225, 200 to 250, 200 to 275, 200 to 300, 250 to 275, 250 to 300, or 275 to 300 nucleotides).

In any embodiment herein, a nucleic acid sequence can have at least 80% sequence identity (e.g., 85%, 90%, 95%, 96%, 97%, 98%, 99%, or 100% sequence identity) to any sequence described herein.

In any embodiment herein, a fragment can include of from about 10 to about 50 nucleotides, such as of from about 10 to 15, 10 to 20, 10 to 25, 10 to 30, 10 to 35, 10 to 40, 10 to 45, 12 to 15, 12 to 20, 12 to 25, 12 to 30, 12 to 35, 12 to 40, 12 to 45, 12 to 50, 15 to 20, 15 to 25, 15 to 30, 15 to 35, 15 to 40, 15 to 45, 15 to 50, 20 to 25, 20 to 30, 20 to 35, 20 to 40, 20 to 45, 20 to 50, 25 to 30, 25 to 35, 25 to 40, 25 to 45, or 25 to 50 nucleotides. In another embodiment, a fragment can include of from about 10 to about 100 nucleotides, such as of from about 10 to 30, 10 to 40, 10 to 50, 10 to 60, 10 to 70, 10 to 80, 10 to 90, 20 to 30, 20 to 40, 20 to 50, 20 to 60, 20 to 70, 20 to 80, 20 to 90, 20 to 100, 30 to 40, 30 to 50, 30 to 60, 30 to 70, 30 to 80, 30 to 90, 30 to 100, 40 to 50, 40 to 60, 40 to 70, 40 to 80, 40 to 90, 40 to 100, 50 to 60, 50 to 70, 50 to 80, 50 to 90, 50 to 100, 60 to 70, 60 to 80, 60 to 90, 60 to 100, 70 to 80, 70 to 90, 70 to 100, 80 to 90, 80 to 100, or 90 to 100 nucleotides. In yet another embodiment, a fragment can include of from about 75 to 250 nucleotides, such as of from about 75 to 100, 75 to 150, 75 to 200, 80 to 100, 80 to 150, 80 to 200, 80 to 250, 90 to 100, 90 to 150, 90 to 200, 90 to 250, 100 to 150, 100 to 200, 100 to 250, 150 to 200, 150 to 250, or 200 to 250 nucleotides (e.g., in which the length can either include or exclude D and/or V).

In any embodiment herein, an amino acid sequence can have at least 80% sequence identity (e.g., 85%, 90%, 95%, 96%, 97%, 98%, 99%, or 100% sequence identity) to any sequence described herein.

In any embodiment herein, a fragment can include of from about 500 to 1800 amino acids, such as of from about 500 to 1700, 500 to 1600, 500 to 1500, 500 to 1400, 500 to 1300, 500 to 1200, 500 to 1100, 500 to 1000, 500 to 950, 500 to 900, 600 to 1800, 600 to 1700, 600 to 1600, 600 to 1500, 600 to 1400, 600 to 1300, 600 to 1200, 600 to 1100, 600 to 1000, 600 to 950, 600 to 900, 700 to 1800, 700 to 1700, 700 to 1600, 700 to 1500, 700 to 1400, 700 to 1300, 700 to 1200, 700 to 1100, 700 to 1000, 700 to 950, 700 to 900, 800 to 1800, 800 to 1700, 800 to 1600, 800 to 1500, 800 to 1400, 800 to 1300, 800 to 1200, 800 to 1100, 800 to 1000, 800 to 950, 800 to 900, 900 to 1800, 900 to 1700, 900 to 1600, 900 to 1500, 900 to 1400, 900 to 1300, 900 to 1200, 900 to 1100, 900 to 1000, 900 to 950, 1000 to 1800, 1000 to 1700, 1000 to 1600, 1000 to 1500, 1000 to 1400, 1000 to 1300, 1000 to 1200, 1000 to 1100, 1100 to 1800, 1100 to 1700, 1100 to 1600, 1100 to 1500, 1100 to 1400, 1100 to 1300, 1100 to 1200, 1200 to 1800, 1200 to 1700, 1200 to 1600, 1200 to 1500, 1200 to 1400, 1200 to 1300, 1300 to 1800, 1300 to 1700, 1300 to 1600, 1300 to 1500, 1300 to 1400, 1400 to 1800, 1400 to 1700, 1400 to 1600, 1400 to 1500, 1500 to 1800, 1500 to 1700, 1500 to 1600, 1600 to 1800, 1600 to 1700, or 1700 to 1800 amino acids.

In any embodiment herein, the nuclease can be a fusion protein including a Cas9 domain and another domain (e.g., a polymerase (e.g., a RNA-dependent RNA polymerase), a riboswitch, a ribozyme, a transcriptional activator, a repressive transcriptional domain, or an epigenetic effector domain.

Definitions

As used herein, the term "about" means +/−10% of any recited value. As used herein, this term modifies any recited value, range of values, or endpoints of one or more ranges.

As used herein, the terms "top," "bottom," "upper," "lower," "above," and "below" are used to provide a relative relationship between structures. The use of these terms does not indicate or require that a particular structure must be located at a particular location.

In accordance with the present invention there may be employed conventional molecular biology, microbiology, and recombinant DNA techniques within the skill of the art. Such techniques are explained fully in the literature. See, e.g., Sambrook et al., 2001, "Molecular Cloning: A Laboratory Manual"; Ausubel, ed., 1994, "Current Protocols in Molecular Biology" Volumes I-III; Celis, ed., 1994, "Cell Biology: A Laboratory Handbook" Volumes I-III; Coligan, ed., 1994, "Current Protocols in Immunology" Volumes I-III; Gait ed., 1984, "Oligonucleotide Synthesis"; Hames & Higgins eds., 1985, "Nucleic Acid Hybridization"; Hames & Higgins, eds., 1984, "Transcription And Translation"; Freshney, ed., 1986, "Animal Cell Culture"; IRL.

The terms "polynucleotide" and "nucleic acid," used interchangeably herein, refer to a polymeric form of nucleotides of any length, either ribonucleotides or deoxyribonucleotides. Thus, this term includes, but is not limited to, single-stranded (e.g., sense or antisense), double-stranded, or multi-stranded ribonucleic acids (RNAs), deoxyribonucleic acids (DNAs), threose nucleic acids (TNAs), glycol nucleic acids (GNAs), peptide nucleic acids (PNAs), locked nucleic acids (LNAs), or hybrids thereof, genomic DNA, cDNA, DNA-RNA hybrids, or a polymer comprising purine and pyrimidine bases or other natural, chemically or biochemically modified, non-natural, or derivatized nucleotide bases. Polynucleotides can have any useful two-dimensional or three-dimensional structure or motif, such as regions including one or more duplex, triplex, quadruplex, hairpin, and/or pseudoknot structures or motifs. For any sequence herein, U may be T, and T may be U.

The term "modified," as used in reference to nucleic acids, means a nucleic acid sequence including one or more modifications to the nucleobase, nucleoside, nucleotide, phosphate group, sugar group, and/or internucleoside linkage (e.g., phosphodiester backbone, linking phosphate, or a phosphodiester linkage).

The nucleoside modification may include, but is not limited to, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, and combinations thereof.

A sugar modification may include, but is not limited to, a locked nucleic acid (LNA, in which the 2'-hydroxyl is connected by a $C_{1-6}$ alkylene (e.g., a multivalent (e.g., bivalent, trivalent, tetravalent, etc.) form of an alkyl group) or $C_{1-6}$ heteroalkylene (e.g., a divalent form of an alkylene group containing one, two, three, or four non carbon heteroatoms (e.g., independently selected from the group consisting of nitrogen, oxygen, phosphorous, sulfur, or halo) bridge to the 4'-carbon of the same ribose sugar), replacement of the oxygen in ribose (e.g., with S, Se, or alkylene, such as methylene or ethylene), addition of a double bond (e.g., to replace ribose with cyclopentenyl or cyclohexenyl), ring contraction of ribose (e.g., to form a 4-membered ring of cyclobutane or oxetane), ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone), multicyclic forms (e.g., tricyclic), and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with a-L-threofuranosyl-(3'→2')), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar.

A backbone modification may include, but is not limited to, 2'-deoxy- or 2'-O-methyl modifications. A phosphate group modification may include, but is not limited to, phosphorothioate, phosphoroselenates, boranophosphates, boranophosphate esters, hydrogen phosphonates, phosphoramidates, phosphorodiamidates, alkyl or aryl phosphonates, phosphotriesters, phosphorodithioates, bridged phosphoramidates, bridged phosphorothioates, or bridged methylene-phosphonates. Additional exemplary modifications include modifications to the 2' position of a nucleic acid, such as 2'-O-methyl, 2'-halo (e.g., 2'-fluoro, 2'-chloro, etc.), 2'-alkyl (e.g., 2'-methyl, 2'-ethyl, 2'-propyl, 2'-allyl, etc.), 2'-aryl (e.g., 2'-phenyl), 2'-alkaryl (e.g., 2'-benzyl), 2'-amino (e.g., 2'-NH$_2$, 2'-NR$^{N1}$R$^{N2}$, which each of R$^{N1}$ and R$^{N2}$ is, independently, H, alkyl, or alkaryl), 2'-alkoxy (e.g. 2'-O-methoxy, 2'-O-ethoxy, etc.), 2'-alkylamine (e.g., 2'-O-methylamine, 2'-O-ethylamine, etc.), 2'-O-alkylamine (e.g., 2'-O-methylamine, 2'-O-ethylamine, etc.), 2'-azido, 2'-O-cyanoalkyl (e.g., 2'-O-cyanomethyl), 2'-O-alkoxylalkyl (e.g., 2'-O-(2-methoxyethyl)), etc.

A phosphate group modification may include, but is not limited to, phosphorothioate, phosphoroselenates, boranophosphates, boranophosphate esters, hydrogen phosphonates, phosphoramidates, phosphorodiamidates, alkyl or aryl phosphonates, phosphotriesters, phosphorodithioates, bridged phosphoramidates, bridged phosphorothioates, or bridged methylene-phosphonates.

"Complementarity" or "complementary" refers to the ability of a nucleic acid to form hydrogen bond(s) with another nucleic acid sequence by either traditional Watson-Crick or other non-traditional types, e.g., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. As is known in the art, standard Watson-Crick base-pairing includes: adenine (A) pairing with thymidine (T), adenine (A) pairing with uracil (U), and guanine (G) pairing with cytosine (C). In addition, it is also known in the art that for hybridization between two RNA molecules (e.g., dsRNA), guanine (G) base pairs with uracil (U). A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" or "sufficient complementarity" as used herein refers to a degree of complementarity that is at least 60%, 65%, 70%, 75%, 80%, 85%, 90%, 95%. 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions.

As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part 1, Second Chapter "Overview of principles of hybridization and the strategy of nucleic acid probe assay", Elsevier, N.Y.

"Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. Hybridization and washing conditions are well known and exemplified in Sambrook J, Fritsch E F, and Maniatis T, "Molecular Cloning: A Laboratory Manual," Second Edition, Cold Spring Harbor Laboratory Press, Cold Spring Harbor (1989), particularly Chapter 11 and Table 11.1 therein; and Sambrook J and Russell W, "Molecular Cloning: A Laboratory Manual," Third Edition, Cold Spring Harbor Laboratory Press, Cold Spring Harbor (2001). The conditions of temperature and ionic strength determine the "stringency" of the hybridization.

Hybridization requires that the two nucleic acids contain complementary sequences, although mismatches between bases are possible. The conditions appropriate for hybridization between two nucleic acids depend on the length of the nucleic acids and the degree of complementation, variables well known in the art. The greater the degree of complementation between two nucleotide sequences, the greater the value of the melting temperature (Tm) for hybrids of nucleic acids having those sequences. For hybridizations between nucleic acids with short stretches of complementarity (e.g., complementarity over 35 or less, 30 or less, 25 or less, 22 or less, 20 or less, or 18 or less nucleotides) the position of mismatches becomes important (see Sambrook et al., supra, 11.7-11.8). Typically, the length for a hybridizable nucleic acid is at least about 10 nucleotides. Illustrative minimum lengths for a hybridizable nucleic acid are: at least about 15 nucleotides; at least about 20 nucleotides; at least about 22 nucleotides; at least about 25 nucleotides; and at least about 30 nucleotides). Furthermore, the skilled artisan will recognize that the temperature and wash solution salt concentration may be adjusted as necessary according to factors such as length of the region of complementation and the degree of complementation.

It is understood in the art that the sequence of polynucleotide need not be 100% complementary to that of its target nucleic acid to be specifically hybridizable or hybridizable. Moreover, a polynucleotide may hybridize over one or more segments such that intervening or adjacent segments are not involved in the hybridization event (e.g., a loop structure or hairpin structure). A polynucleotide can comprise at least 70%, at least 80%, at least 90%, at least 95%, at least 99%, or 100% sequence complementarity to a target region within the target nucleic acid sequence to which they are targeted. For example, an antisense nucleic acid in which 18 of 20 nucleotides of the antisense compound are complementary to a target region, and would therefore specifically hybridize, would represent 90 percent complementarity. In this example, the remaining noncomplementary nucleotides may be clustered or interspersed with complementary nucleotides and need not be contiguous to each other or to complementary nucleotides. Percent complementarity between particular stretches of nucleic acid sequences within nucleic acids can be determined routinely using BLAST programs (basic local alignment search tools) and PowerBLAST programs known in the art (Altschul S F et al., *J. Mol. Biol.* 1990; 215:403-10; Zhang J et al., *Genome Res.* 1997; 7:649-56) or by using the Gap program (Wisconsin Sequence Analysis Package, Version 8 for Unix, Genetics Computer Group, University Research Park, Madison Wis.), using default settings, which uses the algorithm of Smith T F et al., *Adv. Appl. Math.* 1981; 2(4):482-9).

By "protein," "peptide," or "polypeptide," as used interchangeably, is meant any chain of more than two amino acids, regardless of post-translational modification (e.g., glycosylation or phosphorylation), constituting all or part of a naturally occurring polypeptide or peptide, or constituting a non-naturally occurring polypeptide or peptide, which can include coded amino acids, non-coded amino acids, modified amino acids (e.g., chemically and/or biologically modified amino acids), and/or modified backbones.

The term "fragment" is meant a portion of a nucleic acid or a polypeptide that is at least one nucleotide or one amino acid shorter than the reference sequence. This portion contains, preferably, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, 1000, 1250, 1500, 1750, 1800, or more nucleotides; or 10, 20, 30, 40, 50, 60, 70, 80, 90, 100, 150, 200, 250, 300, 350, 400, 450, 500, 550, 600, 640, or more amino acids. In another example, any polypeptide fragment can include a stretch of at least about 5 (e.g., about 10, about 20, about 30, about 40, about 50, or about 100) amino acids that are at least about 40% (e.g., about 50%, about 60%, about 70%, about 80%, about 90%, about 95%, about 87%, about 98%, about 99%, or about 100%) identical to any of the sequences described herein can be utilized in accordance with the invention. In certain embodiments, a polypeptide to be utilized in accordance with the invention includes 2, 3, 4, 5, 6, 7, 8, 9, 10, or more mutations (e.g., one or more conservative amino acid substitutions, as described herein). In yet another example, any nucleic acid fragment can include a stretch of at least about 5 (e.g., about 7, about 8, about 10, about 12, about 14, about 18, about 20, about 24, about 28, about 30, or more) nucleotides that are at least about 40% (about 50%, about 60%, about 70%, about 80%, about 90%, about 95%, about 87%, about 98%, about 99%, or about 100%) identical to any of the sequences described herein can be utilized in accordance with the invention.

The term "conservative amino acid substitution" refers to the interchangeability in proteins of amino acid residues having similar side chains (e.g., of similar size, charge, and/or polarity). For example, a group of amino acids having aliphatic side chains consists of glycine, alanine, valine, leucine, and isoleucine; a group of amino acids having aliphatic-hydroxyl side chains consists of serine and threonine; a group of amino acids having amide containing side chains consisting of asparagine and glutamine; a group of amino acids having aromatic side chains consists of phenylalanine, tyrosine, and tryptophan; a group of amino acids having basic side chains consists of lysine, arginine, and histidine; a group of amino acids having acidic side chains consists of glutamic acid and aspartic acid; and a group of amino acids having sulfur containing side chains consists of cysteine and methionine. Exemplary conservative amino acid substitution groups are valine-leucine-isoleucine, phenylalanine-tyrosine, lysine-arginine, alanine-valine, glycine-serine, glutamate-aspartate, and asparagine-glutamine.

As used herein, when a polypeptide or nucleic acid sequence is referred to as having "at least X % sequence identity" to a reference sequence, it is meant that at least X percent of the amino acids or nucleotides in the polypeptide or nucleic acid are identical to those of the reference sequence when the sequences are optimally aligned. An optimal alignment of sequences can be determined in various ways that are within the skill in the art, for instance, the Smith Waterman alignment algorithm (Smith T F et al., *J. Mol. Biol.* 1981; 147:195-7) and BLAST (Basic Local Alignment Search Tool; Altschul S F et al., *J. Mol. Biol.* 1990; 215:403-10). These and other alignment algorithms are accessible using publicly available computer software such as "Best Fit" (Smith T F et al., *Adv. Appl. Math.* 1981; 2(4):482-9) as incorporated into GeneMatcher Plus™ (Schwarz and Dayhof, "Atlas of Protein Sequence and Structure," ed. Dayhoff, M. O., pp. 353-358, 1979), BLAST, BLAST-2, BLAST-P, BLAST-N, BLAST-X, WU-BLAST-2, ALIGN, ALIGN-2, CLUSTAL, T-COFFEE, MUSCLE, MAFFT, or Megalign (DNASTAR). In addition, those skilled in the art can determine appropriate parameters for measuring alignment, including any algorithms needed to achieve optimal alignment over the length of the sequences being compared. In general, for polypeptides, the length of comparison sequences can be at least five amino acids, preferably 10, 20, 30, 40, 50, 60, 70, 80, 90, 100, 125, 150, 175, 200, 250, 300, 400, 500, 600, 700, or more amino acids, up to the entire length of the polypeptide. For nucleic acids, the length of comparison sequences can generally be at least 10, 20, 30, 40, 50, 60, 70, 80, 90, 100, 125, 150, 175, 200, 250, 300, 400, 500, 600, 700, 800, 900, 1000, 1100, 1200, 1300, 1400, 1500, 1600, 1700, 1800, 1900, 2000, 2100, or more nucleotides, up to the entire length of the nucleic acid molecule. It is understood that for the purposes of determining sequence identity when comparing a DNA sequence to an RNA sequence, a thymine nucleotide is equivalent to a uracil nucleotide.

By "substantial identity" or "substantially identical" is meant a polypeptide or nucleic acid sequence that has the same polypeptide or nucleic acid sequence, respectively, as a reference sequence, or has a specified percentage of amino acid residues or nucleotides, respectively, that are the same at the corresponding location within a reference sequence when the two sequences are optimally aligned. For example, an amino acid sequence that is "substantially identical" to a reference sequence has at least about 50%, 60%, 70%, 75%, 80%, 85%, 90%, 95%, 96%, 97%, 98%, 99%, or 100% sequence identity to the reference amino acid sequence. For polypeptides, the length of comparison sequences will generally be at least 5, 6, 7, 8, 9, 10, 11, 12, 13, 14, 15, 16, 17, 18, 19, 20, 25, 50, 75, 90, 100, 150, 200, 250, 300, or 350 contiguous amino acids (e.g., a full-length sequence). For nucleic acids, the length of comparison sequences will generally be at least 5, 10, 11, 12, 13, 14, 15, 16, 17, 18, 19, 20, 21, 22, 23, 24, or 25 contiguous nucleotides (e.g., the full-length nucleotide sequence). Sequence identity may be measured using sequence analysis software on the default setting (e.g., Sequence Analysis Software Package of the Genetics Computer Group, University of Wisconsin Biotechnology Center, 1710 University Avenue, Madison, Wis., 53705). Such software may match similar sequences by assigning degrees of homology to various substitutions, deletions, and other modifications.

A "target sequence" as used herein is a polynucleotide (e.g., as defined herein, including a DNA, RNA, or DNA/RNA hybrid, as well as modified forms thereof) that includes a "target site." The terms "target site" is used to refer to a nucleic acid sequence present in a non-target strand or a target genomic sequence (e.g., DNA or RNA in a host or pathogen) to which a primer (e.g., any herein) will bind provided sufficient conditions (e.g., sufficient complementarity) for binding to exist. Suitable DNA/RNA binding conditions include physiological conditions normally present in a cell. Other suitable DNA/RNA binding conditions (e.g., conditions in a cell-free system) are known in the art; see, e.g., Sambrook, supra.

By "cleavage" it is meant the breakage of the covalent backbone of a target sequence (e.g., a nucleic acid molecule). Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. DNA cleavage can result in the production of either blunt ends or staggered ends. In certain embodiments, a complex comprising a guiding component and a nuclease is used for targeted double-stranded DNA cleavage or single-stranded DNA cleavage.

"Nuclease" and "endonuclease" are used interchangeably herein to mean an enzyme which possesses catalytic activity for cleavage of a nucleic acid sequence.

By "cleavage domain" or "active domain" or "nuclease domain" of a nuclease it is meant the polypeptide sequence or domain within the nuclease which possesses the catalytic activity for nucleic acid cleavage. A cleavage domain can be contained in a single polypeptide chain or cleavage activity can result from the association of two (or more) polypeptides. A single nuclease domain may consist of more than one isolated stretch of amino acids within a given polypeptide.

By "linker" is meant any useful multivalent (e.g., bivalent) component useful for joining to different portions or segments. Exemplary linkers include a nucleic acid sequence, a chemical linker, etc. For example, the linker can have a length of from about 3 nucleotides (nt) to about 90 nt, from about 3 nucleotides (nt) to about 80 nt, from about 3 nucleotides (nt) to about 70 nt, from about 3 nucleotides (nt) to about 60 nt, from about 3 nucleotides (nt) to about 50 nt, from about 3 nucleotides (nt) to about 40 nt, from about 3 nucleotides (nt) to about 30 nt, from about 3 nucleotides (nt) to about 20 nt or from about 3 nucleotides (nt) to about 10 nt. For example, the linker can have a length of from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt.

In some embodiments, the linker of a single-molecule guiding component is 4 nt. Other exemplary linkers include polyethylene glycol, an alkane chain, an alkyene group, a click-chemistry linker, a polynucleotide (e.g., poly(T), $(T)_n$, poly(G), $(G)_n$, $(GGGS)_n$, where n is any useful integer, such as 1, 2, 3, 4, 5, 6, 7, 8, 9, 10, etc.), and/or a carbocyclic ring (e.g., an aromatic ring, such as a phenyl group).

"Operably linked" or "operatively linked" or "operatively associated with," as used interchangeably, refers to a juxtaposition wherein the components so described are in a relationship permitting them to function in their intended manner. A first component can be operably linked to a second component by way of any useful bond (e.g., a covalent bond, a non-covalent bond, and/or linked via van der Waals forces, hydrogen bonds, and/or other intermolecular forces, such as those including a π-π interaction, a salt bridge, or a cation-π interaction) or any useful linker (e.g., any herein).

A "vector" or "expression vector" is a replicon, such as plasmid, phage, virus, or cosmid, to which another nucleic acid segment, i.e., an "insert", may be attached so as to bring about the replication of the attached segment in a cell.

By "salt" is meant an ionic form of a compound or structure (e.g., any nucleic acid sequence, reagent, compounds, or compositions described herein), which includes a cation or anion compound to form an electrically neutral compound or structure. Salts are well known in the art. For example, non-toxic salts, pharmaceutically acceptable salts are described in Berge S M et al., "Pharmaceutical salts," *J. Pharm. Sci.* 1977 January; 66(1):1-19; and in "Handbook of Pharmaceutical Salts: Properties, Selection, and Use," Wiley-VCH, April 2011 (2nd rev. ed., eds. P. H. Stahl and C. G. Wermuth). The salts can be prepared in situ during the final isolation and purification of the compounds of the invention or separately by reacting the free base group with a suitable organic acid (thereby producing an anionic salt) or by reacting the acid group with a suitable metal or organic salt (thereby producing a cationic salt). Representative anionic salts include acetate, adipate, alginate, ascorbate, aspartate, benzenesulfonate, benzoate, bicarbonate, bisulfate, bitartrate, borate, bromide, butyrate, camphorate, camphorsulfonate, chloride, citrate, cyclopentanepropionate, digluconate, dihydrochloride, diphosphate, dodecylsulfate, edetate, ethanesulfonate, fumarate, glucoheptonate, glucomate, glutamate, glycerophosphate, hemisulfate, heptonate, hexanoate, hydrobromide, hydrochloride, hydroiodide, hydroxyethanesulfonate, hydroxynaphthoate, iodide, lactate, lactobionate, laurate, lauryl sulfate, malate, maleate, malonate, mandelate, mesylate, methanesulfonate, methylbromide, methylnitrate, methylsulfate, mucate, 2-naphthalenesulfonate, nicotinate, nitrate, oleate, oxalate, palmitate, pamoate, pectinate, persulfate, 3-phenylpropionate, phosphate, picrate, pivalate, polygalacturonate, propionate, salicylate, stearate, subacetate, succinate, sulfate, tannate, tartrate, theophyllinate, thiocyanate, triethiodide, toluenesulfonate, undecanoate, valerate salts, and the like. Representative cationic salts include metal salts, such as alkali or alkaline earth salts, e.g., barium, calcium (e.g., calcium edetate), lithium, magnesium, potassium, sodium, and the like; other metal salts, such as aluminum, bismuth, iron, and zinc; as well as nontoxic ammonium, quaternary ammonium, and amine cations, including, but not limited to ammonium, tetramethylammonium, tetraethylammonium, methylamine, dimethylamine, trimethylamine, triethylamine, ethylamine, pyridinium, and the like. Other cationic salts include organic salts, such as chloroprocaine, choline, dibenzylethylenediamine, diethanolamine, ethylenediamine, methylglucamine, and procaine.

By "pharmaceutically acceptable salt" is meant a salt that is, within the scope of sound medical judgment, suitable for use in contact with the tissues of humans and animals without undue toxicity, irritation, allergic response and the like and are commensurate with a reasonable benefit/risk ratio.

By "pharmaceutically acceptable excipient" is meant any ingredient other than a compound or structure (e.g., any formulas, compounds, or compositions described herein) and having the properties of being nontoxic and non-inflammatory in a subject. Exemplary, non-limiting excipients include adjuvants, antiadherents, antioxidants, binders, carriers, coatings, compression aids, diluents, disintegrants, dispersing agents, dyes (colors), emollients, emulsifiers, fillers (diluents), film formers or coatings, flavors, fragrances, glidants (flow enhancers), isotonic carriers, lubricants, preservatives, printing inks, solvents, sorbents, stabilizers, suspensing or dispersing agents, surfactants, sweeteners, waters of hydration, or wetting agents. Any of the excipients can be selected from those approved, for example, by the United States Food and Drug Administration or other governmental agency as being acceptable for use in humans or domestic animals. Exemplary excipients include, but are not limited to alcohol, butylated hydroxytoluene (BHT), calcium carbonate, calcium phosphate (dibasic), calcium stearate, croscarmellose, cross-linked polyvinyl pyrrolidone, citric acid, crospovidone, cysteine, ethylcellulose, gelatin, glycerol, hydroxypropyl cellulose, hydroxypropyl methylcellulose, lactated Ringer's solution, lactose, magnesium stearate, maltitol, maltose, mannitol, methionine, methylcellulose, methyl paraben, microcrystalline cellulose, polyethylene glycol, polyol, polyvinyl pyrrolidone, povidone, pregelatinized starch, propyl paraben, retinyl palmitate, Ringer's solution, shellac, silicon dioxide, sodium carboxymethyl cellulose, sodium chloride injection, sodium citrate, sodium starch glycolate, sorbitol, starch (corn), stearic acid, stearic acid, sucrose, talc, titanium dioxide, vegetable oil, vitamin A, vitamin E, vitamin C, water, and xylitol.

By an "effective amount" or a "sufficient amount" of an agent, as used herein, is that amount sufficient to effect beneficial or desired results, such as clinical results, and, as such, an "effective amount" depends upon the context in which it is being applied. For example, in the context of administering an agent that is a repressor of a gene, an effective amount of an agent is, for example, an amount sufficient to achieve a reduction in that gene's expression, as compared to the response obtained without administration of the agent.

By "subject" is meant a human, a non-human animal (e.g., a mammal), a host (e.g., a subject exposed to a pathogen, such as a human host exposed to a pathogen), a plant, a bacterium, or a pathogen (e.g., a virus, a phage, a bacterium, or a fungus).

By "treating" a disease, disorder, or condition in a subject is meant reducing at least one symptom of the disease, disorder, or condition by administrating a therapeutic agent to the subject. By "treating prophylactically" a disease, disorder, or condition in a subject is meant reducing the frequency of occurrence of or reducing the severity of a disease, disorder or condition by administering a therapeutic agent to the subject prior to the onset of disease symptoms. Beneficial or desired results can include, but are not limited to, alleviation or amelioration of one or more symptoms or conditions; diminishment of extent of disease, disorder, or condition; stabilized (i.e., not worsening) state of disease, disorder, or condition; preventing spread of disease, disorder, or condition; delay or slowing the progress of the disease, disorder, or condition; amelioration or palliation of the disease, disorder, or condition; and remission (whether partial or total), whether detectable or undetectable.

Other features and advantages of the invention will be apparent from the following description and the claims.

BRIEF DESCRIPTION OF THE DRAWINGS

FIG. 6 shows a schematic of an assay conducted in a high-throughput format.

FIG. 7A-7F shows a comparison of quenched FRET substrates for measuring Cas9 activity. Schematic representations of the "same-strand" (A) and "opposite-strand" (B) substrates showing the relative locations of the fluorophore, quenchers, and HNH and RuvC cleavage sites. The fluorescence of the "same-strand" (C) and "opposite-strand." (D) substrates when incubated with an excess of the wt or dCas9 and sgRNA before and after addition of a Gdn-HCl quench. The fluorescence of the "same-strand" (E) and "opposite-strand" (F) substrates when incubated with an excess of the indicated Cas9 and sgRNA after the addition of 4M Gdn-HCl quench. Data are the average and standard deviation of three replicate wells.

FIG. 8A-8B shows results from a denaturing PAGE Cas9 cleavage assay. (A) Schematic representation showing the location and relative lengths of the strands of the dual FAM-labeled denaturing PAGE substrate. (B) Representative gel image showing the PAGE assay treated under the same conditions as in FIG. 7E-7F.

FIG. 9 provides the sequences of the substrates for Spy (SEQ ID NOs:3 and 4), Sau (SEQ ID NOs:3 and 4), and Cje Cas9 (SEQ ID NOs:5 and 6). The underlined portion indicates the sequence of the corresponding guide RNA, the bold indicates the PAM sequence, and the symbols indicate the cleavage locations.

FIG. 10 shows adapting the quenched FRET assay for additional species of Cas9. The fluorescence of the Sau Cas9 and Cje Cas9 substrates when treated with an excess of Cas9 and sgRNA after addition of 4M Gdn-HCl quench and 1 hour incubation at 55° C. Data are the average and standard deviation of three replicate wells.

FIG. 11A-11C shows profiling of species specificity of anti-CRISPRs. Fluorescence values of reactions of the Spy Cas9 (A), Sau Cas9 (B), or Cje Cas9 (C) assay with the indicated concentration of AcrIIA4 or AcrIIC1. The average fluorescence of controls containing either no Cas9 or no inhibitor are shown with the dashed lines. Where applicable, the data were fit to a dose-response curve with a hill slope of 1 to determine the $IC_{50}$. Data are the average and standard deviation of three replicate wells.

FIG. 14 shows cytotoxicity results of Cas9 inhibitor hit compounds. Hela cells were plated in a 96-well plate and grown for 48 hours in the presence of 10 µM of each inhibitor (or a DMSO control). Cell viability was assessed by PrestoBlue reagent and fluorescence was measured according to the manufacturer's instructions FIG. 15A-15F shows exemplary protein sequences for Cas9 proteins (from the N to C terminus). Provided are protein sequences for (A) wild-type *Staphylococcus aureus* Cas9 (SauCas, SEQ ID NO:100), (B) dSauCas9 (D10A and N580A, SEQ ID NO:101), (C) *Streptococcus pyogenes* Cas9 (SpyCas, SEQ ID NO:102), (D) dSpyCas9 (D10A and H840A, SEQ ID NO:103), (E) *Campylobacter jejuni* Cas9 (CjeCas9, SEQ ID NO:104), and (F) *Francisella novicida* Cas9 (FnoCas9, SEQ ID NO:105). Further protein sequences can include one or more of SEQ ID NOs:100-105, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:100-105 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 16A-16Q shows further exemplary protein sequences for Cas9 proteins (from the N to C terminus). Provided are protein sequences for (A) *Staphylococcus aureus* Cas9 (UniProtKB J7RUA5, SEQ ID NO:110), (B) *Campylobacter jejuni* subsp. *jejuni* serotype 0:2 Cas9 (UniProtKB Q0P897, SEQ ID NO:111), (C) *Streptococcus thermophilus* Cas9 (UniProtKB G3ECR1, SEQ ID NO:112), (D) *Streptococcus thermophilus* (strain ATCC BAA-491/LMD-9) Cas9-1 (UniProtKB Q03LF7, SEQ ID NO:113), (E) *Streptococcus thermophilus* (strain ATCC BAA-491/LMD-9) Cas9-2 (UniProtKB Q03JI6, SEQ ID NO:114), (F) *Wolinella succinogenes* Cas9 (UniProtKB Q7MRD3, SEQ ID NO:115), (G) *Wolinella succinogenes* Cas9/Csx12 (NCBI WP_011139431.1, SEQ ID NO:116), (H) *Staphylococcus lugdunensis* Cas9 (UniProtKB A0A133QCR3, SEQ ID NO:117), (I) *Staphylococcus pseudintermedius* ED99 Cas9 (GenBank ADX75954.1, SEQ ID NO:118), (J) *Helicobacter mustelae* Cas9 (UniProtKB D3UFL8, SEQ ID NO:119), (K) *Streptococcus pasteurianus* Cas9 (UniProtKB A0A135YMA6, SEQ ID NO:120), (L) *Streptococcus pasteurianus* (strain ATCC 43144 JCM 5346 CDC 1723-81) Cas9 (UniProtKB F5X275, SEQ ID NO:121), (M) *Listeria innocua* Clip11262 (UniProtKB Q927P4.1, SEQ ID NO:122), (N) *Neisseria meningitidis*, serogroup C (strain 8013) Cas9 (SEQ ID NO:123), (O) *Neisseria meningitidis*, serogroup A/serotype 4A (strain Z2491) Cas9 (SEQ ID NO:124), (P) *Geobacillus stearothermophilus* Cas9 (SEQ ID NO:125), and *Geobacillus* sp. LC300 Cas 9 (SEQ ID NO:126). Further protein sequences can include one or more of SEQ ID NOs:110-126, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:110-126 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 19A-19G provides non-limiting nucleic acid sequences that can be employed as a first portion, a linker, and/or a second portion of a synthetic guiding component (SEQ ID NOs:150-349). In one non-limiting instance, the synthetic guiding component has a structure provided by formula 5'-D-V-E-L-F-3', in which D is a third portion, V is a targeting portion, E is a first portion, L is a linker, and F is a second portion, as described herein. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:150-349 or a fragment thereof.

FIG. 20A-20B shows further non-limiting synthetic guiding components, in which (D) is a third portion and (V) is a targeting portion, as described herein (SEQ ID NOs:350-387). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs: 350-387 or a fragment thereof.

FIG. 21A-21B provides non-limiting nucleic acid sequences that can be employed as (A) a target strand (SEQ ID NOs:388-399) or (B) a non-target strand (SEQ ID NOs:400-417).

FIG. 24A-24C shows further exemplary protein sequences for Cas12a proteins (from the N to C terminus). Further protein sequences can include one or more of SEQ ID NOs:420-422, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:420-422 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 25A-25C provides non-limiting nucleic acid sequences that can be employed as a first portion, a linker, and/or a second portion of a synthetic guiding component (SEQ ID NOs:425-536) (e.g., for use with Cas12a). In one non-limiting instance, the synthetic guiding component has a structure provided by formula 5'-F-L-E-V-D-3' or 5'-E-V-D-3' or 5'-(E-V)$_e$-D-3', in which D is a third portion, V is a targeting portion, E is a first portion, L is a linker, and F is a second portion, as described herein. In particular embodiments, e is an integer of from about 1 to about 20. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:425-536 or a fragment thereof.

FIG. 26 shows further non-limiting synthetic guiding components (e.g., for use with Cas12a), in which (D) is a third portion and (V) is a targeting portion, as described herein (SEQ ID NOs:537-564). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:537-564 or a fragment thereof.

FIG. 27A-27D shows further exemplary protein sequences for Cas12b proteins (from the N to C terminus). Further protein sequences can include one or more of SEQ ID NOs:570-573, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:570-573 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 28A-28D provides non-limiting nucleic acid sequences that can be employed as a first portion, a linker, and/or a second portion of a synthetic guiding component (SEQ ID NOs:580-671) (e.g., for use with Cas12b). In one non-limiting instance, the synthetic guiding component has a structure provided by formula 5'-F-L-E-V-D-3' or 5'-E-V-D-3' or 5'-(E-V)$_e$-D-3', in which D is a third portion, V is a targeting portion, E is a first portion, L is a linker, and F is a second portion, as described herein. In particular embodiments, e is an integer of from about 1 to about 20. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:580-671 or a fragment thereof.

FIG. 29A-29B shows further non-limiting synthetic guiding components (e.g., for use with Cas12b), in which (D) is a third portion and (V) is a targeting portion, as described herein (SEQ ID NOs:672-699). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:672-699 or a fragment thereof.

FIG. 30A-30H shows further exemplary protein sequences for CasY proteins (from the N to C terminus). Further protein sequences can include one or more of SEQ ID NOs:700-707, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:700-707 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 31A-31G provides non-limiting nucleic acid sequences that can be employed as a first portion, a linker, and/or a second portion of a synthetic guiding component (SEQ ID NOs:710-800) (e.g., for use with CasY). In one non-limiting instance, the synthetic guiding component has a structure provided by formula 5'-F-L-E-V-D-3' or 5'-E-V-D-3' or 5'-(E-V)$_e$-D-3', in which D is a third portion, V is a targeting portion, E is a first portion, L is a linker, and F is a second portion, as described herein. In particular embodiments, e is an integer of from about 1 to about 20. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:710-800 or a fragment thereof.

FIG. 32 shows further non-limiting synthetic guiding components (e.g., for use with CasY), in which (D) is a third portion and (V) is a targeting portion, as described herein (SEQ ID NOs:801-814). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:801-814 or a fragment thereof.

FIG. 33A-33C shows further exemplary protein sequences for CasX proteins (from the N to C terminus). Further protein sequences can include one or more of SEQ ID NOs:820-822, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:820-822 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 34A-34C provides non-limiting nucleic acid sequences that can be employed as a first portion, a linker, and/or a second portion of a synthetic guiding component (SEQ ID NOs:825-878) (e.g., for use with CasX). In one non-limiting instance, the synthetic guiding component has a structure provided by formula 5'-F-L-E-V-D-3' or 5'-E-V-D-3' or 5'-(E-V)$_e$-D-3', in which D is a third portion, V is a targeting portion, E is a first portion, L is a linker, and F is a second portion, as described herein. In particular embodiments, e is an integer of from about 1 to about 20. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:825-878 or a fragment thereof.

FIG. 35 shows further non-limiting synthetic guiding components (e.g., for use with CasX), in which (D) is a third portion and (V) is a targeting portion, as described herein (SEQ ID NOs:879-902). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:879-902 or a fragment thereof.

FIG. 36A-36D shows further exemplary protein sequences for Cas13a proteins (from the N to C terminus). Further protein sequences can include one or more of SEQ ID NOs:910-913, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:910-913 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 37A-37D provides non-limiting nucleic acid sequences that can be employed as a first portion, a linker, and/or a second portion of a synthetic guiding component (SEQ ID NOs:915-981) (e.g., for use with Cas13a). In one non-limiting instance, the synthetic guiding component has a structure provided by formula 5'-F-L-E-V-D-3' or 5'-E-V-D-3' or 5'-(E-V)$_e$-D-3', in which D is a third portion, V is a targeting portion, E is a first portion, L is a linker, and F is a second portion, as described herein. In particular embodiments, e is an integer of from about 1 to about 20. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:915-981 or a fragment thereof.

FIG. 38 shows further non-limiting synthetic guiding components (e.g., for use with Cas13a), in which (D) is a third portion and (V) is a targeting portion, as described herein (SEQ ID NOs:982-1003). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:982-1003 or a fragment thereof.

FIG. 39A-39B shows further exemplary protein sequences for Cas13b proteins (from the N to C terminus). Further protein sequences can include one or more of SEQ ID NOs:1005-1006, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:1005-1006 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 40A-40B provides non-limiting nucleic acid sequences that can be employed as a first portion, a linker, and/or a second portion of a synthetic guiding component (SEQ ID NOs:1010-1046) (e.g., for use with Cas13b). In one non-limiting instance, the synthetic guiding component has a structure provided by formula 5'-D-V-E-L-F-3' or 5'-V-E-D-3' or 5'-(V-E)$_e$-D-3', in which D is a third portion, V is a targeting portion, E is a first portion, L is a linker, and F is a second portion, as described herein. In particular embodiments, e is an integer of from about 1 to about 20. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs: 1010-1046 or a fragment thereof.

FIG. 41 shows further non-limiting synthetic guiding components (e.g., for use with Cas13b), in which (D) is a third portion and (V) is a targeting portion, as described herein (SEQ ID NOs:1047-1056). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:1047-1056 or a fragment thereof.

FIG. 42A-42G shows further exemplary protein sequences for Cas13d proteins (from the N to C terminus). Further protein sequences can include one or more of SEQ ID NOs:1060-1066, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:1060-1066 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 43A-43D provides non-limiting nucleic acid sequences that can be employed as a first portion, a linker, and/or a second portion of a synthetic guiding component (SEQ ID NOs:1070-1150) (e.g., for use with Cas13d). In one non-limiting instance, the synthetic guiding component has a structure provided by formula 5'-F-L-E-V-D-3' or 5'-E-V-D-3' or 5'-(E-V)$_e$-D-3', in which D is a third portion, V is a targeting portion, E is a first portion, L is a linker, and F is a second portion, as described herein. In particular embodiments, e is an integer of from about 1 to about 20. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:1070-1150 or a fragment thereof.

FIG. 44 shows further non-limiting synthetic guiding components (e.g., for use with Cas13d), in which (D) is a third portion and (V) is a targeting portion, as described herein (SEQ ID NOs:1151-1172). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:1151-1172 or a fragment thereof.

FIG. 45A-45C shows further exemplary protein sequences for Cas14a proteins (from the N to C terminus). Further protein sequences can include one or more of SEQ ID NOs:1175-1177, or a fragment thereof, having one or more conservative amino acid substitutions, as defined herein; and one or more sequences that is substantially identical (e.g., having at least about 80%, 85%, 90%, 95%, 96%, 97%, 98%, 99%, or 100% sequence identity) to one or more of SEQ ID NOs:1175-1177 or a fragment thereof (e.g., a fragment having of from about 500 to 1500 amino acids, e.g., 500 to 1400, 500 to 1300, 500 to 1200, 500 to 1100, 500 to 1000, 500 to 950, 500 to 900, etc.).

FIG. 46 provides non-limiting nucleic acid sequences that can be employed as a first portion, a linker, and/or a second portion of a synthetic guiding component (SEQ ID NOs: 1180-1199) (e.g., for use with Cas14a). In one non-limiting instance, the synthetic guiding component has a structure provided by formula 5'-F-L-E-V-D-3' or 5'-E-V-D-3' or 5'-(E-V)$_e$-D-3', in which D is a third portion, V is a targeting portion, E is a first portion, L is a linker, and F is a second portion, as described herein. In particular embodiments, e is an integer of from about 1 to about 20. In each instance, U can be substituted by T, and vice versa. Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:1180-1199 or a fragment thereof.

FIG. 47A-47B shows further non-limiting synthetic guiding components (e.g., for use with Cas14a), in which (D) is a third portion and (V) is a targeting portion, as described herein (SEQ ID NOs:1200-1219). Further nucleic acid sequences can include one or more sequences that is substantially identical (e.g., having at least about 80%, 85%, 90%, 95%, 96%, 97%, 98%, 99%, or 100% sequence identity) to one or more of SEQ ID NOs:1200-1219 or a fragment thereof.

DETAILED DESCRIPTION OF THE INVENTION

The present invention relates, in part, to a CRISPR-Cas based assay by employing a cleavage substrate. In particular embodiments, the cleavage substrate forms a duplex having two strands: a target strand and a non-target strand. The target strand includes a target site configured to bind to the targeting portion of a synthetic guide RNA (sgRNA), and the non-target strand includes a protospacer adjacent motif (PAM). The targeting portion can be any use length (e.g., about 20 nucleotides).

The target strand and the non-target strand can include one or more labels. In one non-exemplary configuration, the target strand includes a fluorophore at the 5'-end, and the non-target strand includes a quencher at the 3'-end. In another exemplary configuration, the target strand does not include a label, and the non-target strand includes a first label within the strand and a second label at the 3'-end.

Figure 1A:
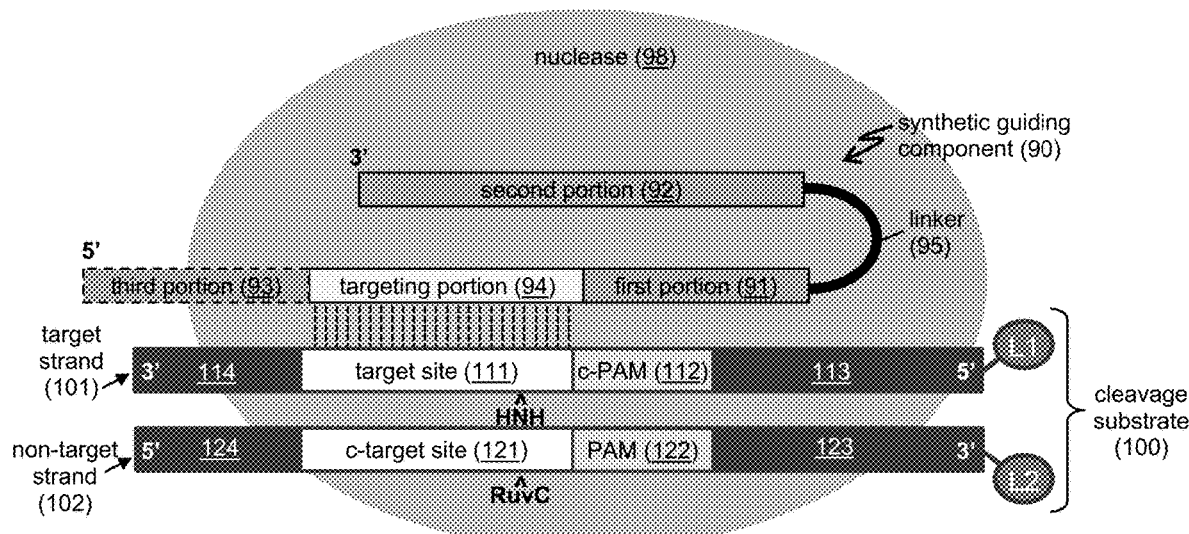
FIG. 1A-1B shows an exemplary CRISPR-CAS based assay for cleaving a cleavage substrate. Provided are (A) a schematic of an exemplary cleavage substrate 100, which interacts with a synthetic guiding component 90 and a nuclease 98; and (B) a schematic of an exemplary assay employing a cleavage substrate including a fluorescent label on the target strand and a quencher label on the non-target strand.

FIG. 1A provides an exemplary cleavage substrate 100, which is a duplex formed by the binding of a target strand 101 to the non-target strand 102. This figure also provides an exemplary synthetic guiding component 90, which in turn includes a targeting portion 94, a first portion 91, a second portion 92, an optional third portion 93, and a linker 95. In general, the targeting portion 94 includes a nucleic acid sequence that is sufficiently complementary to a desired target site 111 of the target strand 101. In this way, the guiding component can be programmed to bind to and interact with certain portions of a target strand. The first and second portions 91,92 provide interactions sites with the nuclease 98 (e.g., a Cas9 nuclease), thereby providing the nuclease in proximity to the target site; and the linker 95 joins the first and second portions.

The cleavage substrate includes various regions, including a target strand 101 having a first binding region 113, a complementary PAM region 112 (e.g., a sufficiently complementary PAM region), a target site 111, and a second binding region 114. The non-target strand 102 includes a third binding region 124, a complementary target site 121 (e.g., a sufficiently complementary target site), a PAM region 122, and a fourth binding region 123. As seen in FIG. 1A, the target strand includes a first label L1, and the non-target strand includes a second label L2. In general, the target strand includes a cleavage site (e.g., a HNH cleavage site) within the target site, and the non-target strand includes a cleavage site (e.g., a RuvC cleavage site) within the complementary target site.

As can be seen, the cleavage substrate and the synthetic guiding component can be designed to interact with a particular nuclease (e.g., by way of the PAM region in the cleavage substrate and by way of the first portion, linker, and second portion in the synthetic guiding component). Furthermore, the synthetic guiding component can be designed to interact with the cleavage substrate by selecting sufficiently complementary targeting portions and target sites. Also, the target strands and non-target strands can be designed to form a duplex by selecting sufficiently complementary regions in proximity to the target site and the PAM site (e.g., binding region 113 sufficiently complementary to binding region 123, and binding region 114 sufficiently complementary to binding region 124).

Figure 1B:
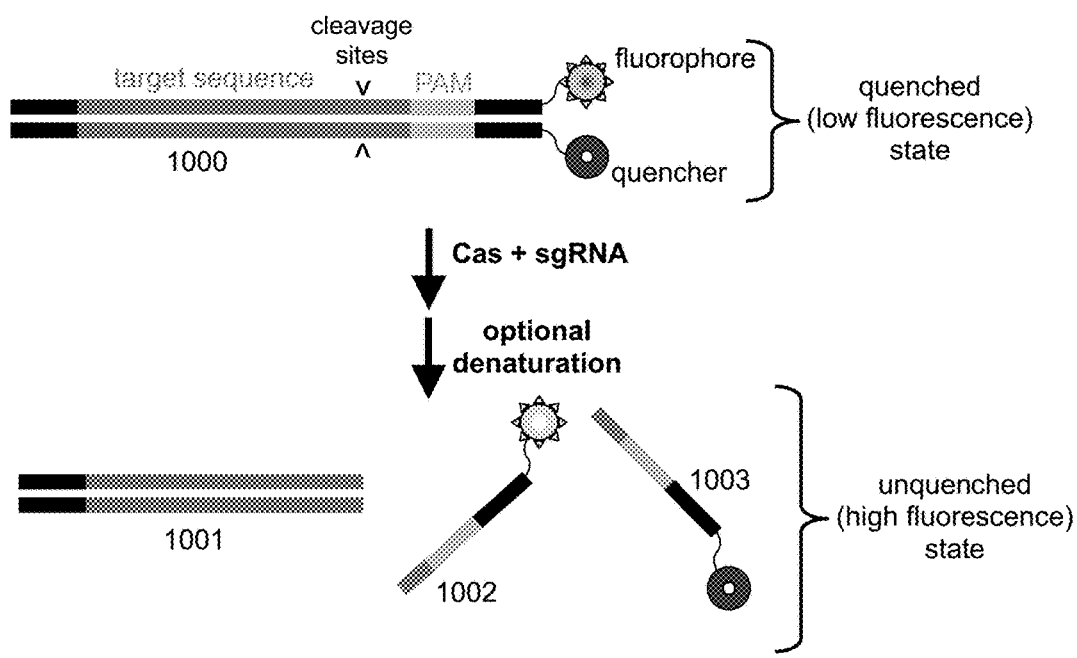

FIG. 1B provides an exemplary assay conducted with a cleavage substrate 1000, in which the target strand includes a fluorophore and the non-target strand includes a quencher. The fluorophore and quencher form a FRET pair, and formation of the duplex provides sufficient proximity of these labels, such that fluorescence emission by the fluorophore is quenched or minimized. Upon providing a synthetic guiding component (e.g., a synthetic guide RNA, sgRNA) and a nuclease, the nuclease and sgRNA form a ribonucleoprotein complex (RNP).

Furthermore, the sgRNA also binds to the cleavage substrate, thereby facilitating nuclease cleavage of the substrate at the cleavage site. The resultant cleavage products include a first cleaved portion that is unlabeled 1001, a second cleaved portion including the fluorophore 1002, and a third cleaved portion including a quencher 1003. Optionally, one or more denaturation steps are conducted to facilitate release of the substrate by the nuclease. Exemplary protein denaturation conditions include, e.g., use of a chaotropic agent, such as any herein; or use of heat to denature the protein.

Figure 2A:
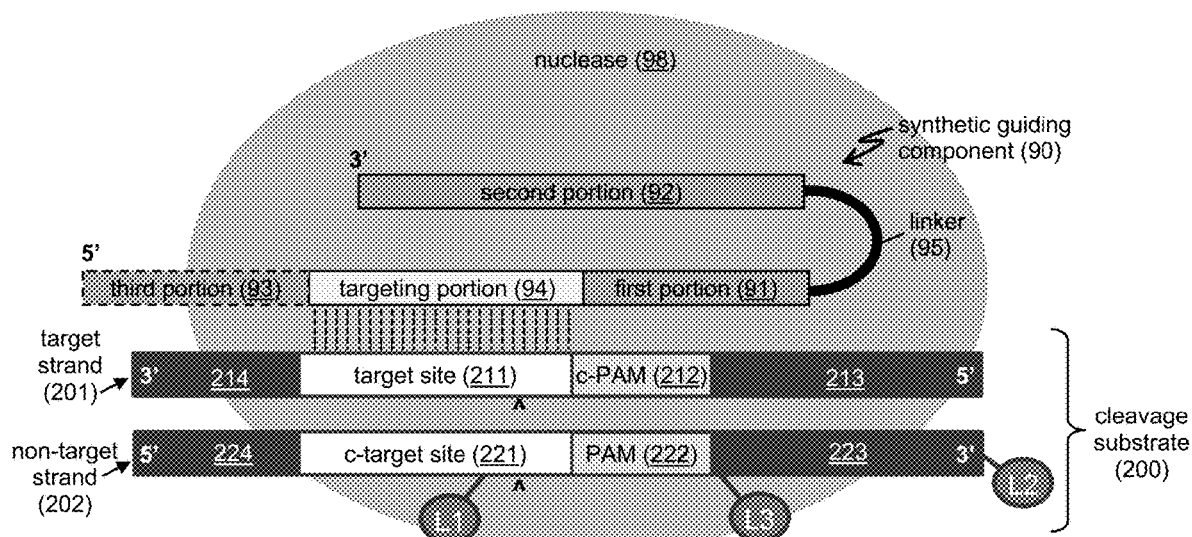
FIG. 2A-2B shows another exemplary CRISPR-CAS based assay for cleaving a cleavage substrate. Provided are (A) a schematic of an exemplary cleavage substrate 200 having a non-labeled target strand 201 and a labeled non-target strand 202; and (B) a schematic of an exemplary assay employing a cleavage substrate including a fluorescent label and a quencher label on the non-target strand.

FIG. 2A provides another exemplary cleavage substrate 200, in which the target strand 201 is not labeled. Rather, labels are present on the non-target strand 202. Again, the cleavage substrate includes various regions, including a target strand 201 having a first binding region 213, a complementary PAM region 212 (e.g., a sufficiently complementary PAM region), a target site 211, and a second binding region 214. The non-target strand 202 includes a third binding region 224, a complementary target site 221 (e.g., a sufficiently complementary target site), a PAM region 222, and a fourth binding region 223.

Figure 2B:
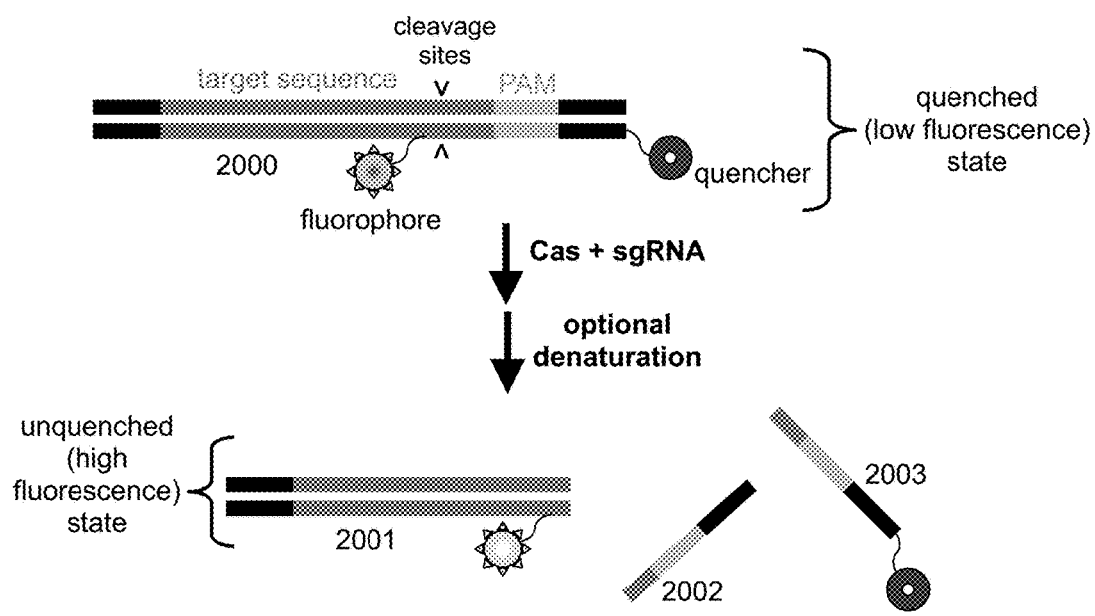

As also seen in FIG. 2A, the non-target strand includes a first label L1 upstream of the cleavage site, a second label L2 at the 3'-end, and an optional third label L3 downstream of the cleavage site (e.g., and/or downstream of the PAM region). FIG. 2B provides an exemplary assay conducted with a cleavage substrate 2000, in which the target strand is unlabeled, but the non-target strand includes a fluorophore upstream of the cleavage site and a quencher downstream of the cleavage site. Again, the fluorophore and quencher form a FRET pair. Upon scission at the cleavage site, the fluorophore and quencher will be separated, thus allowing detectable fluorescence emission by the fluorophore.

Upon providing a synthetic guiding component (e.g., a synthetic guide RNA, sgRNA) and a nuclease, interactions between the nuclease, sgRNA, and cleavage substrate can facilitate nuclease cleavage of the substrate at the cleavage site. The resultant cleavage products include a first cleaved portion including the fluorophore 2001, a second cleaved portion that is unlabeled 2002, and a third cleaved portion including a quencher 2003. Optionally, one or more denaturation steps are conducted to facilitate release of the substrate by the nuclease.

Target Strands and Non-Target Strands

Figure 3A:
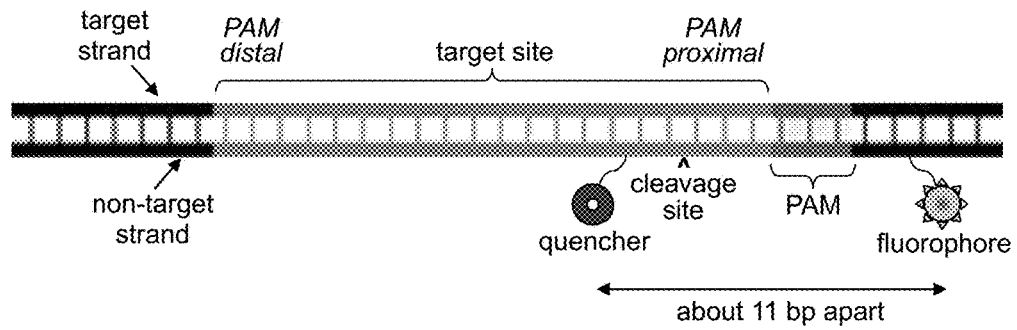
FIG. 3A-3C shows exemplary cleavage substrates having a non-labeled target strand. Provided are (A) a schematic of a labeled non-target strand including a quencher and a terminal fluorophore; (B) a schematic of a labeled non-target strand including a fluorophore and a terminal quencher; and (C) a schematic of a labeled non-target strand including a fluorophore, an internal quencher, and a terminal quencher.
Figure 3B:
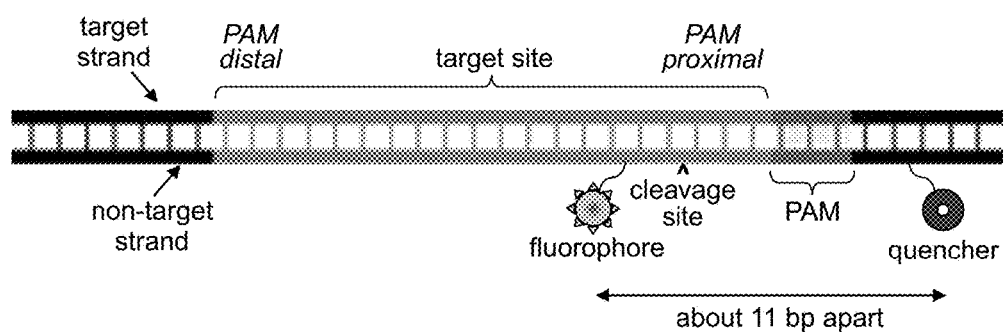

Target strands and non-target strands can be designed to form a duplex, in which cleavage of at least one of the strands includes a label (e.g., any described herein) provide a detectable signal. In one instance, the target strand is not labeled, and the non-target strand includes two or more labels. FIG. 3A-3B provides exemplary cleavage substrates. For instance, the non-target strand can include a first label upstream of the cleavage site and a second label downstream of the cleavage site, in which the first label is a quencher and the second label is fluorophore (FIG. 3A) or the first label is a fluorophore and the second label is quencher (FIG. 3B). The distance between the first and second labels can be chosen to minimize background emission prior to cleavage by the nuclease. In one instance, one label is within the target site, and the other label is downstream of the PAM region or at the 3'-end.

Figure 3C:
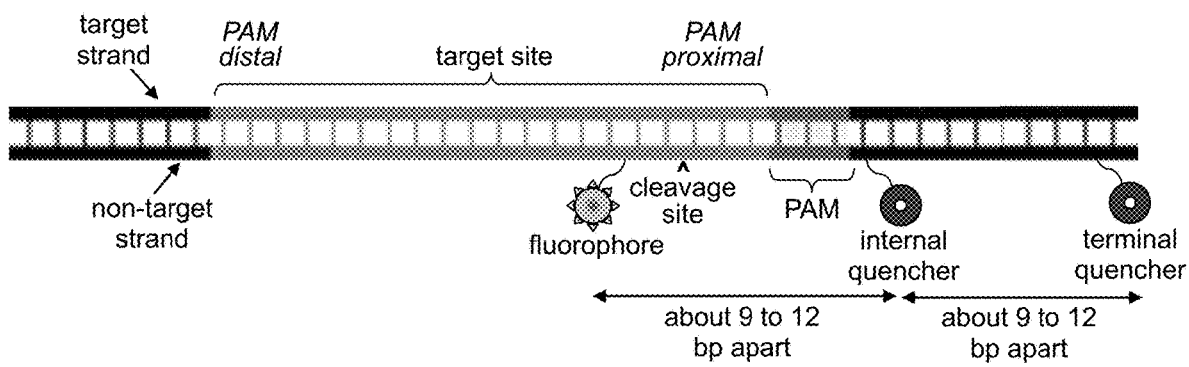

In another instance, an internal quencher is employed. For example, the non-target strand can include a first label upstream of the cleavage site, a second label downstream of the cleavage site, and a third label further downstream of the cleavage site. As seen in FIG. 3C, the first label can be a fluorophore, the second label can be an internal quencher, and the third label can be a terminal quencher.

Figure 4A:
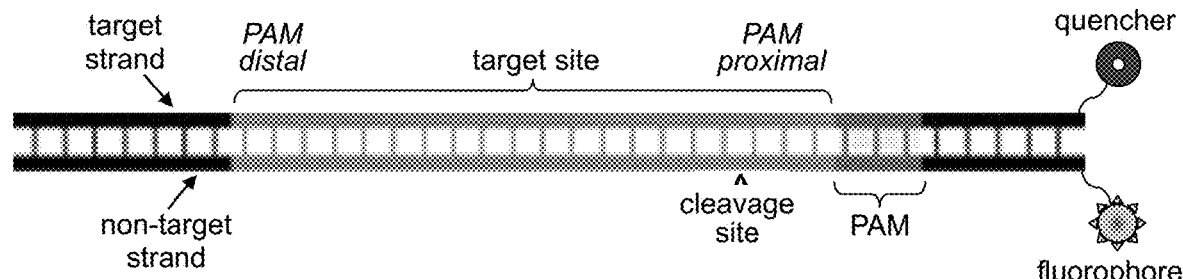
FIG. 4A-4C shows exemplary cleavage substrates having a labeled target strand. Provided are (A) a schematic of a labeled target strand including a quencher and a labeled non-target strand including a fluorophore; (B) a schematic of a labeled target strand including a fluorophore and a labeled non-target strand including a quencher; and (C) a schematic of a labeled target strand having a 5' overhang.
Figure 4B:
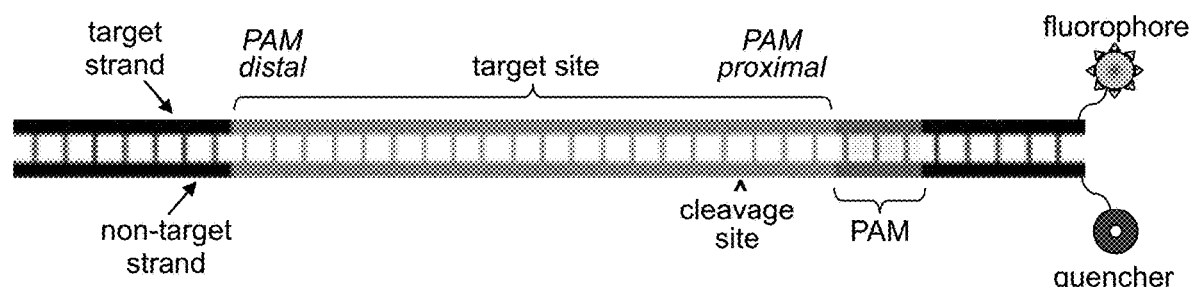
Figure 4C:
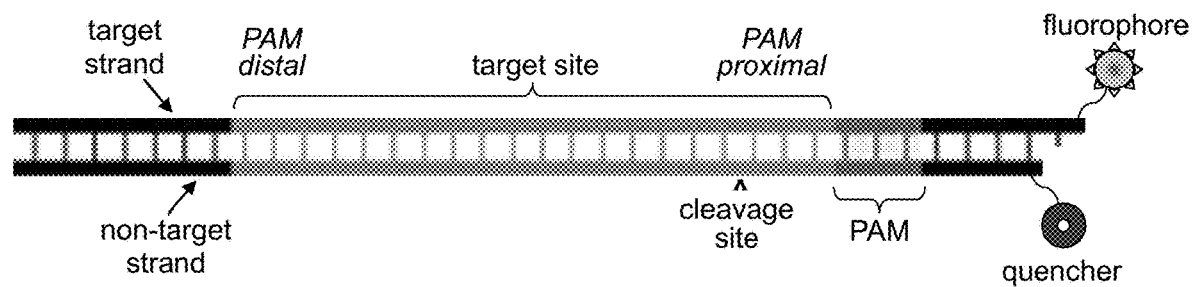

In other instances, the target strand can include a first label, and the non-target strand can include a second label. For instance, the target strand can include a first label at the 5'-end, and the non-target strand can include a second label at the 3'-end, in which the first label is a quencher and the second label is fluorophore (FIG. 4A) or the first label is a fluorophore and the second label is quencher (FIG. 4B). Any useful constructs can be employed to provide beneficial binding prior to cleavage, improved unbinding after cleavage, and/or ease of synthesis of the constructs. As seen in FIG. 4C, the target strand can include a 5'-overhang.

The target strand can have any useful structure. In one instance, the target strand includes a structure having formula (Ia) of 5'-X-Y-T-Z-3' or formula (Ib) of 5'-Z-T-Y-X-3' or a salt thereof, wherein: X is a first binding region including a nucleic acid sequence, Y is a PAM-binding region including a nucleic acid sequence configured to bind to a PAM in the non-target strand, T is a target site including a nucleic acid sequence configured to bind to a targeting portion of the synthetic guiding component, and Z is a second binding region including a nucleic acid sequence (e.g., any described herein). In some embodiments, the target strand includes a nucleic acid sequence having at least 80% sequence identity to any one of SEQ ID NOs: 1, 3, 5, 7, and 282-293 or a complement of any of these, or a fragment thereof.

The non-target strand can have any useful structure. In one instance, the non-target strand includes a structure having formula (IIa) of 5'-A-U-B-C-3' or formula (IIb) of 5'-C-B-U-A-3' or a salt thereof, wherein: A is a third binding region including a nucleic acid sequence configured to bind to Z or a portion thereof, U is a complementary target site including a nucleic acid sequence configured to bind T or a portion thereof, B is the PAM configured to interact with the target nuclease, and C is a second binding region including a nucleic acid sequence configured to bind X or a portion thereof. In some embodiments, the non-target strand includes a nucleic acid sequence having at least 80% sequence identity to any one of SEQ ID NOs: 2, 4, 6, 8, and 294-311 (see FIG. 21A-21B) or a complement of any of these, or a fragment thereof.

Binding regions X and C are generally sufficiently complementary to one another. However, in some instances, X may be longer than C, in which case, alignment of these two regions would include the extended portion of X. X can be any useful nucleic acid sequence, e.g., a nucleic acid sequence having at least 80% sequence identity to any one of SEQ ID NOs:20-30 (see Table 1) or a complement of any of these, or a fragment thereof; or at least 80% sequence identity to a complement of any one of SEQ ID NOs:47-58, or a fragment thereof. C can be any useful nucleic acid sequence, e.g., a nucleic acid sequence having at least 80% sequence identity to any one of SEQ ID NOs:47-58 or a complement of any of these, or a fragment thereof; or at least 80% sequence identity to a complement of any one of SEQ ID NOs:20-30, or a fragment thereof.

Binding regions Y and B are generally sufficiently complementary to one another. Y can be any useful nucleic acid sequence, e.g., a nucleic acid sequence having at least 80% sequence identity to any one of SEQ ID NOs:31-33 or a complement of any of these, or a fragment thereof; or at least 80% sequence identity to a complement of any one of SEQ ID NOs:44-46, or a fragment thereof. B can be any useful nucleic acid sequence, e.g., a nucleic acid sequence having at least 80% sequence identity to any one of SEQ ID NOs:44-46 or a complement of any of these, or a fragment thereof, or at least 80% sequence identity to a complement of any one of SEQ ID NOs:31-33, or a fragment thereof.

Binding regions Z and A are generally sufficiently complementary to one another. Z can be any useful nucleic acid sequence, e.g., a nucleic acid sequence having at least 80% sequence identity to any one of SEQ ID NOs:34-38 or a complement of any of these, or a fragment thereof; or at least 80% sequence identity to a complement of any one of SEQ ID NOs:39-43, or a fragment thereof. A can be any useful nucleic acid sequence, e.g., a nucleic acid sequence having at least 80% sequence identity to any one of SEQ ID NOs:39-43 or a complement of any of these, or a fragment thereof, or at least 80% sequence identity to a complement of any one of SEQ ID NOs:34-38, or a fragment thereof.

TABLE 1

Nucleic acid sequences for target strands and non-target strands

| Name | Sequence (5' to 3') | SEQ ID NO: |
|---|---|---|
| X1 | TGAGCAAGCTGACGTTTGTACT | 20 |
| X2 | AGCAAGCTGACGTTTGTACT | 21 |
| X3 | TGCTGACGTTTGTACT | 22 |
| X4 | GCTGACGTTTGTACT | 23 |
| X5 | TGACGTTTGTACT | 24 |
| X6 | GACGTTTGTACT | 25 |
| X7 | GTTTGTACT | 26 |
| X8 | TGTACT | 27 |
| X9 | TACT | 28 |
| X10 | TCCG | 29 |
| X11 | TGT | 30 |
| Y1 | CCA | 31 |
| Y2 | ACTCCA | 32 |
| Y3 | TGTTCAC | 33 |
| Z1 | AGCAGAGATTTCTGCTGTGC | 34 |
| Z2 | AGCAGAGATTTCTGCTG | 35 |
| Z3 | AGAGATTTCTGCTGTGC | 36 |
| Z4 | AGAGATTTCTGCTG | 37 |
| Z5 | AGCAGAGATTTCTGCTGTGA | 38 |
| A1 | GCACAGCAGAAATCTCTGCT | 39 |
| A2 | GCACAGCAGAAATCTCT | 40 |
| A3 | CAGCAGAAATCTCTGCT | 41 |
| A4 | CAGCAGAAATCTCT | 42 |
| A5 | TCACAGCAGAAATCTCTGCT | 43 |
| B1 | TGG | 44 |
| B2 | TGGAGT | 45 |
| B3 | GTGAACA | 46 |
| C1 | AGTACAAACGTCAGCTTGCT | 47 |
| C2 | AGTACAAACGTCAGC | 48 |
| C3 | AGdTACAAACGTCAGC | 49 |
| C4 | AGTACAAACGTCA | 50 |
| C5 | AGTACAAACGTC | 51 |
| C6 | AGTACAAAC | 52 |

TABLE 1-continued

Nucleic acid sequences for target strands and non-target strands

| Name | Sequence (5' to 3') | SEQ ID NO: |
|---|---|---|
| C7 | AGTACA | 53 |
| C8 | AGTA | 54 |
| C9 | ACA | 55 |
| C10 | A | 56 |
| C11 | CGGA | 57 |
| C12 | CG | 58 |

Any useful PAM sequence can be employed (e.g., in region B). Exemplary PAM sequences include, without limitation, NGG, NGGN, NGGNN, TGGN, GRRN, NGRRT, NGRRN, NNGRRT, NNARRT, NNCRRT, NNTRRT, NNNNACA, NNNNRYAC, NNAGAAW, RGAAN, AGAAN, NNAGAAN, NNANMAN, NGGNG, NNGNK, NTTN, NTTV, NNNNRYAC, NNAGAAW, NNAGAA, NGGNG, NNNNGATT, or NAAAAC, for adenine (A), cytosine (C), guanine (C), thymine (T), uracil (U), G or T or U (K), A or C (M), A, T, U, C, or G (N), A or G (R), A, C, or G (V), A or T or U (W), and C or T or U (Y) (e.g., in which for any of these sequences, T is replaced with U). In particular embodiments, B includes NGG or NGGN, e.g., TGG or TGGN (for Spy); GRRN or NGRRT or NGRRN or NNGRRT, e.g., GAAN, GAGN, TGGAGT, NNGAGT, NNGGGT, NNGAAT, or NNGGAT (for Sau); NNNNACA or NNNNRYAC, e.g., GTGAACA, GGGGACAC, AGGCACAC, (for Cje); NNAGAAW or NNAGAA or NGGNG (for Sth); and NTTN, e.g., TTTG, TTTC, TTTA, GTTA, or GTTC (for Fno). Y may be a sequence that is sufficiently complementary to any PAM sequence described herein.

Also disclosed herein are exemplary structures for the target strand and the non-target strand. In one embodiment, the target strand has a structure of formula (Ia): 5'-X-Y-T-Z-3' or of formula (Ib): 5'-Z-T-Y-X-3', in which X is a first binding region, Y is a complementary PAM region (or a PAM-binding region) configured to bind B, T is a target site configured to bind the targeting portion of the synthetic guiding component, and Z is a second binding region. In some embodiments, the label (e.g., a fluorophore) is provided at the 5'-end of the target strand, and X is about 6 nucleic acids in length. In another embodiment, the non-target strand has a structure of formula (IIa): 5'-A-U-B-C-3' or of formula (IIb): 5'-C-B-U-A-3', in which A is a third binding region configured to bind Z, U is a complementary target site configured to bind T, B is a PAM region configured to interact with the nuclease, and C is a fourth binding region configured to bind X. In some embodiments, the label (e.g., a quencher) is provided at the 3'-end of the non-target strand, and C is about 4 nucleic acids in length. In other embodiments, X is longer than C. In other embodiments, a first label (e.g., a fluorophore) is provided within region U and a second label (e.g., a quencher) is provided at the 3'-end. In yet other embodiments, a first label (e.g., a fluorophore) is provided within region U and upstream of the cleavage site, a second label (e.g., a quencher) is provided within region U and downstream of the cleavage site, and a third label (e.g., a quencher) is provided at the 3'-end.

In particular embodiments, the target strand does not include a label, and the non-target strand includes labels. In some embodiments, the non-target strand includes a first label (e.g., a fluorophore) upstream (e.g., by about 2 ntds) of the Cas cleavage site and a second label (e.g., a quencher) downstream (e.g., by about 3 ntds) of the PAM region. The target strand and the non-target strand can be annealed to provide a duplex.

In addition, the target strands, non-target strands, and synthetic guiding components can be formed from any useful combination of one or more nucleic acids (or a polymer of nucleic acids, such as a polynucleotide). Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a R-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids, chimeras, or modified forms thereof. Exemplary modifications include any useful modification, such as to the sugar, the nucleobase, or the internucleoside linkage (e.g., to a linking phosphate/to a phosphodiester linkage/to the phosphodiester backbone). One or more atoms of a pyrimidine nucleobase may be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present invention may be modifications of ribonucleic acids (RNAs) to deoxyribonucleic acids (DNAs), threose nucleic acids (TNAs), glycol nucleic acids (GNAs), peptide nucleic acids (PNAs), locked nucleic acids (LNAs) or hybrids thereof). Additional modifications are described herein.

Synthetic Guiding Component

Figure 17A:
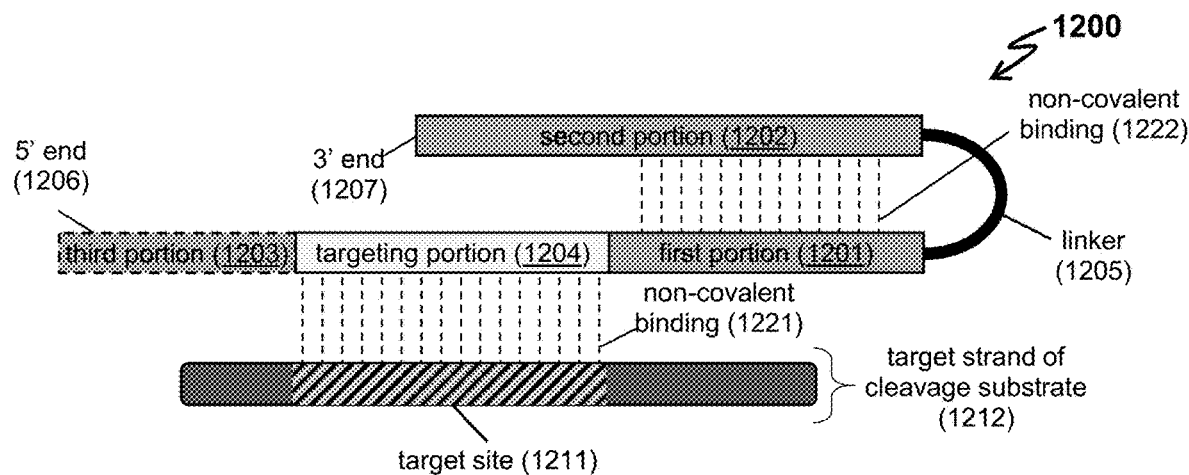
FIG. 17A-17D shows exemplary synthetic guiding components. Provided are (A) a schematic of non-limiting interactions between the targeting portion 1204 of the synthetic guiding component 1200 with the target site 1211 of the target strand 1212 by non-covalent binding 1221, as well as interactions between the first portion 1201 and second portion 1202 of the component 1200; (B) a schematic of a non-limiting synthetic guiding component 1300 having a targeting portion 1304, a first portion 1301, a second portion 1302, an optional third portion 1303, and a linker 1305 disposed between the first and second portions; (C) a schematic of a non-limiting synthetic guiding component 1350 having a targeting portion 1354, a first portion 1351, a second portion 1352 having a hairpin, an optional third portion 1353, and a linker 1355 disposed between the first and second portions; and (D) a schematic of non-limiting interactions between the targeting portion 1404 of the synthetic guiding component 1400 with the target site 1411 of the target strand 1421 by non-covalent binding 1421, as well as interactions between the first portion 1401 and second portion 1402 of the component 1400.

The synthetic guiding component can have any useful structure. FIG. 17A shows an exemplary synthetic guiding component 1200 interacting with the target site 1211 of the target strand 1212. The synthetic guiding component 1200 binds to the target site 1211 by way of a targeting portion 1204 through non-covalent binding 1221. In this manner, the targeting portion confers specificity to the guiding component, thereby allowing certain target sequences to be activated, inactivated, and/or modified.

The synthetic guiding component 1200 also includes a first portion 1201, a second portion 1202, and a linker 1205 that covalently links the first and second portions. These portions at the 3' end are configured to recruit the nuclease (e.g., a Cas nuclease) in proximity to the site of the target sequence. Thus, these portions include nucleic acid sequences that provide preferential binding (e.g., specific binding) of the nuclease. Once in proximity, the nuclease can bind and/or cleave the target sequence or a sequence in proximity to the target sequence in a site-specific, programmable manner. In some embodiments, the first and second portions interact by way of non-covalent binding 1222, thereby providing secondary structure that beneficially interacts with the nuclease.

Figure 17B:
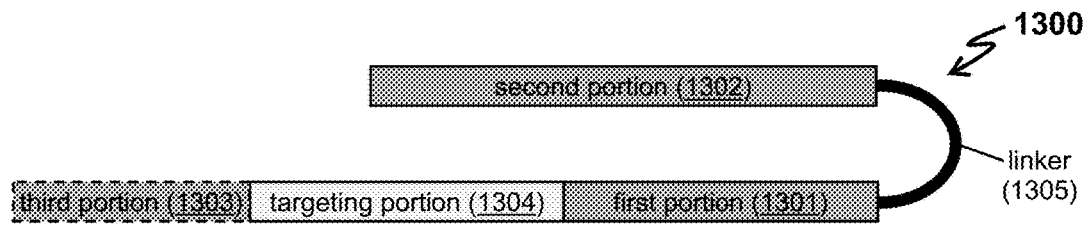
Figure 17C:
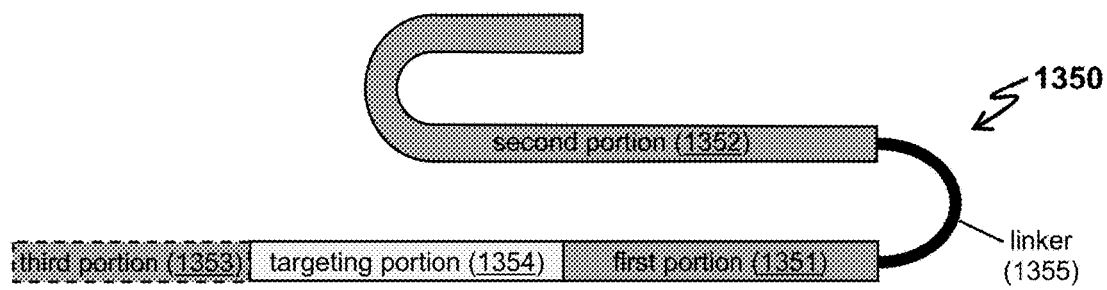

The synthetic guiding component 1200 can optionally include a third portion 1203 at the 5' end 1206. The sequence and/or the nucleic acid modifications of the third portion can be optimized to promote binding to the target site or to provide a more accessible substrate to ribonucleoprotein complex. Also provided are guiding components including duplex binding (FIG. 17B) or a hairpin structure (FIG. 17C).

The synthetic guiding component can have portions arranged in any useful manner. For instance, as seen in FIG. 17D, the component can include the targeting portion 1404 in proximity to the 3' end 1406, as compared to the component 1200 in FIG. 17A having a targeting portion 1204 in proximity to the 5' end 1206.

Figure 17D:
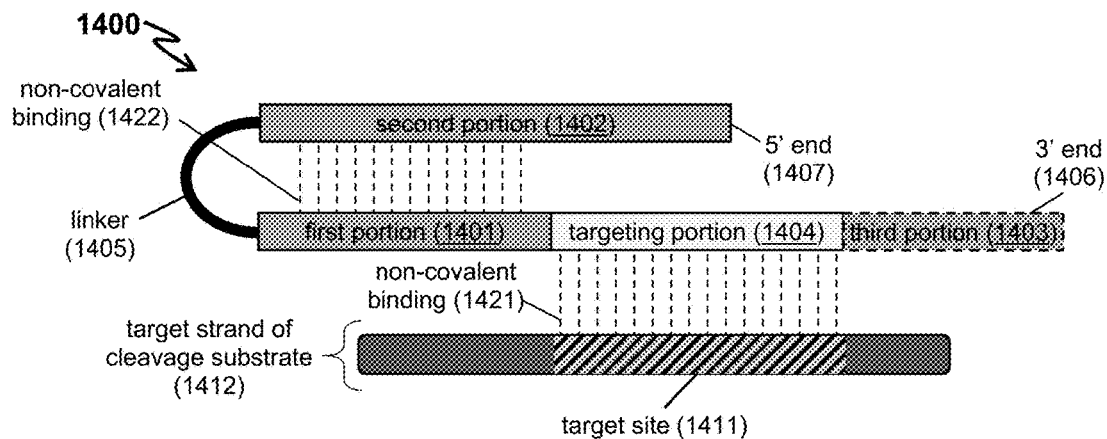

FIG. 17D further shows an exemplary synthetic guiding component 1400 interacting with the target site 1411 of the target strand 1412. The synthetic guiding component 1400 binds to the target site 1411 by way of a targeting portion 1404 through non-covalent binding 1421. In this manner, the targeting portion confers specificity to the guiding component, thereby allowing certain target sequences to be activated, inactivated, and/or modified. The synthetic guiding component 1400 also includes a first portion 1401 (e.g., any described herein), a second portion 1402 (e.g., any described herein), and a linker 1405 (e.g., any described herein) that covalently links the first and second portions.

Figure 18A:
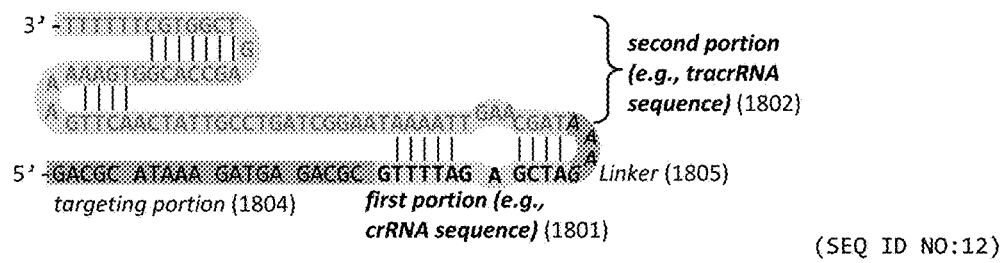
FIG. 18A-18E shows non-limiting synthetic guiding components and cleavage substrates. Provided are (A) a schematic of an exemplary synthetic guiding component (SEQ ID NO: 12) including a first portion 1801 (e.g., a crRNA sequence, such as any described herein), a second portion 1802 (e.g., a tracrRNA sequence, such as any described herein), a targeting portion 1804, and a linker 1805; (B) a schematic of the exemplary synthetic guiding component 1800 bound to a target site 1811 of an exemplary cleavage substrate 1810 including a target strand (SEQ ID NO:1) and a non-target strand (SEQ ID NO: 2), in which * indicates a label or a dT having a label; and (C) a schematic of the exemplary synthetic guiding component 1800 bound to a target site 1821 of another exemplary cleavage substrate 1820 including a target strand (SEQ ID NO:3) and a non-target strand (SEQ ID NO: 4), in which * indicates a label or a dT having a label. Also provided are (D) a schematic of an exemplary synthetic guiding component (SEQ ID NO:13) including a first portion 1901 and a second portion 1902 (e.g., together being a crRNA sequence, such as any described herein), a targeting portion 1904, and a linker 1905; and (E) a schematic of the exemplary synthetic guiding component 1900 bound to a target site 1921 of another exemplary cleavage substrate including a target strand (SEQ ID NO:3) and a non-target strand (SEQ ID NO: 4), in which * indicates a label or a dT having a label.
Figure 18B:
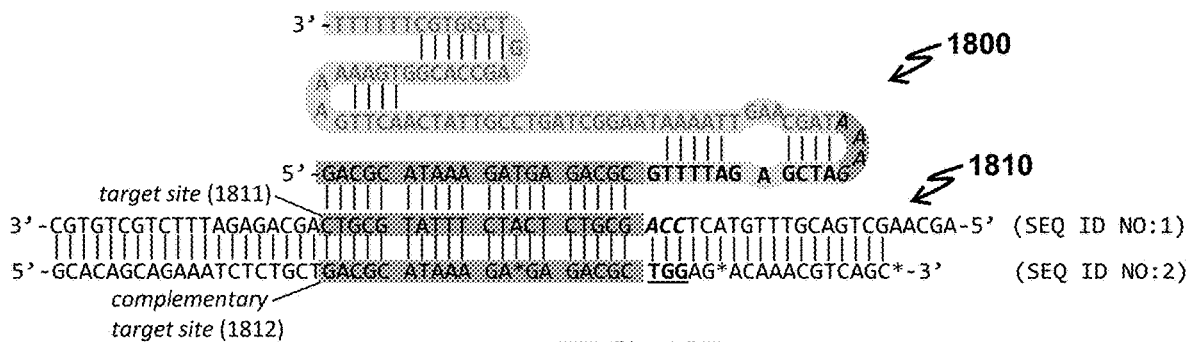
Figure 18C:
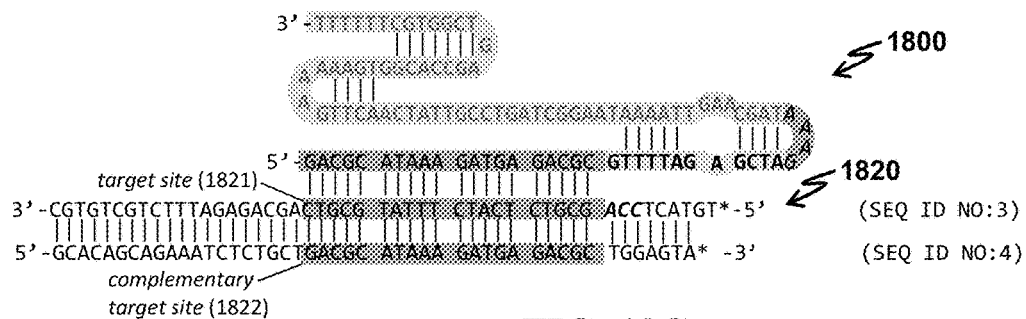

FIG. 18A-18B provides exemplary synthetic guiding components derived from crRNA and tracrRNA sequences. As can be seen, the exemplary synthetic guiding component includes a first portion 1801 (e.g., a crRNA sequence), a second portion 1802 (e.g., a tracrRNA sequence), a linker 1805 that covalently links the first and second portions, and a targeting portion 1804. Upon binding, the synthetic guiding component 1800 interacts with the target site 1811 of the target strand (SEQ ID NO:1). FIG. 18C provides another cleavage substrate 1820 bound to the guiding component 1800.

Figure 18D:
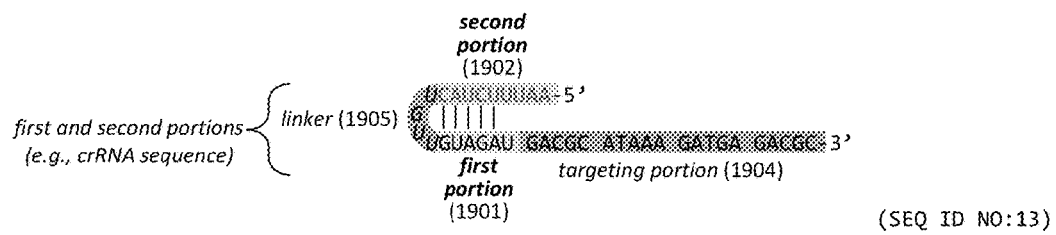
Figure 18E:
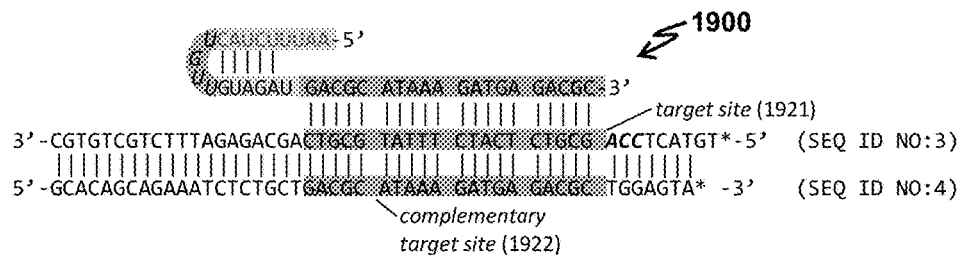

FIG. 18D provides an exemplary synthetic guiding component (SEQ ID NO:13) derived from crRNA sequences. As can be seen, the exemplary synthetic guiding component includes a first portion 1901 and a second portion 1902 (e.g., together a crRNA sequence) with a linker 1905 that covalently links the first and second portions, and a targeting portion 1904. Upon binding (FIG. 18E), the synthetic guiding component 1900 interacts with the target site 1921 of the target strand (SEQ ID NO:3), which in turn is non-covalently bound to a non-target strand (SEQ ID NO:4).

The first portion, second portion, and linker can be derived in any useful manner. In one instance, the first portion can include a crRNA sequence, a consensus sequence derived from known crRNA sequences, a modified crRNA sequence, or an entirely synthetic sequence known to bind a Cas nuclease or determined to competitively bind a Cas nuclease when compared to a known crRNA sequence. Exemplary sequences for a first portion (e.g., for Cas9, such as any described herein) are described in FIG. 19A-19G (SEQ ID NOs:150-159, 184-189, 213-220, 249-264, 282-287, 308-311, and 331-336). In some embodiments, the first portion is a crRNA sequence that exhibits at least 50%, 60%, 70%, 80%, 90%, 95%, or 99% of sequence complementarity to any one of SEQ ID NOs:150-159, 184-189, 213-220, 249-264, 282-287, 308-311, and 331-336. In other embodiments, the first portion is a fragment (e.g., having a length of about 4, 5, 6, 7, 8, 9, 10, 11, 12, 13, 14, 15, 16, 17, 18, 19, 20, 22, 24, 26, 28, 30, 32, 34, 36, 38, 40, or more nucleotides) of a crRNA sequence that exhibits at least 50%, 60%, 70%, 80%, 90%, 95%, or 99% of sequence complementarity to any one of SEQ ID NOs:150-159, 184-189, 213-220, 249-264, 282-287, 308-311, and 331-336.

In another instance, the second portion can include a tracrRNA sequence, a consensus sequence derived from known tracrRNA sequences, a modified tracrRNA sequence, or an entirely synthetic sequence known to bind a Cas nuclease or determined to competitively bind a Cas nuclease when compared to a known tracrRNA sequence. Exemplary sequences for a second portion are described in FIG. 19A-19G (SEQ ID NOs:166-183, 196-212, 228-248, 271-281, 295-307, 318-330, and 342-349). In some embodiments, the second portion is a tracrRNA sequence that exhibits at least 50%, 60%, 70%, 80%, 90%, 95%, or 99% of sequence complementarity to any one of SEQ ID NOs:166-183, 196-212, 228-248, 271-281, 295-307, 318-330, and 342-349. In other embodiments, the second portion is a fragment (e.g., having a length of about 4, 5, 6, 7, 8, 9, 10, 11, 12, 13, 14, 15, 16, 17, 18, 19, 20, 22, 24, 26, 28, 30, 32, 34, 36, 38, 40, or more nucleotides) of a tracrRNA sequence that exhibits at least 50%, 60%, 70%, 80%, 90%, 95%, or 99% of sequence complementarity to any one of SEQ ID NOs: 166-183, 196-212, 228-248, 271-281, 295-307, 318-330, and 342-349.

The linker can be any useful linker (e.g., including one or more transcribable elements, such as a nucleotide or a nucleic acid, or including one or more chemical linkers). Further, the linker can be derived from a fragment of any useful tracrRNA sequence (e.g., any described herein). The first and second portions can interact in any useful manner. For example, the first portion can have a sequence portion that is sufficiently complementary to a sequence portion of the second portion, thereby facilitating duplex formation or non-covalent bonding between the first and second portion. In another example, the second portion can include a first sequence portion that is sufficiently complementary to a second sequence portion, thereby facilitating hairpin formation within the second portion. Exemplary sequences for a linker are described in FIG. 19A-19G (SEQ ID NOs:160-165, 190-195, 221-227, 265-270, 288-294, 312-317, 337-341). In some embodiments, the linker is a sequence that exhibits at least 50%, 60%, 70%, 80%, 90%, 95%, or 99% of sequence complementarity to any one of SEQ ID NOs: 160-165, 190-195, 221-227, 265-270, 288-294, 312-317, 337-341.

In one instance, the synthetic guiding component includes a structure having formula (IIIa) of 5'-D-V-E-L-F-3' or formula (IIIb) of 5'-F-L-E-V-D-3' or formula (IIIc) 5'-E-V-D-3' or (IIId) 5'-(E-V)$_e$-D-3' or a salt thereof, wherein: D is an optional third portion including a nucleic acid sequence of from about 1 to 20 nucleic acids; V is a targeting portion including a nucleic acid sequence configured to bind to a target site of the cleavage substrate; E is a first portion including a nucleic acid sequence configured to interact with a nuclease configured to bind and/or cleave the cleavage substrate; L is a linker; and F is a second portion including a nucleic acid sequence configured to interact with the target nuclease and E or a portion thereof. In particular embodiments, e is an integer of from about 1 to about 20. In some embodiments, the synthetic guiding component includes a nucleic acid sequence having at least 80% sequence identity to any one of SEQ ID NOs: 9-12, 350-387, and 388-399 (see FIG. 20A-20B) or a complement of any of these, or a fragment thereof.

Further synthetic guiding components, first portions, second portions, third portions, and linkers are described in FIGS. 25A-25C, 26, 28A-28D, 29A-29B, 31A-31G, 32, 34A-34C, 35, 37A-37D, 38, 40A-40B, 41, 43A-43D, 44, 46, and 47A-47B.

Nuclease

The nuclease may be a Cas9 homolog or ortholog. In some embodiments, the nuclease is codon-optimized for expression in a eukaryotic cell. In some embodiments, the nuclease directs cleavage of one or two strands at the location of the target sequence.

Any useful Cas protein or complex can be employed that binds to and/or cleaves a double-stranded sequence. Exemplary Cas proteins or complexes include those involved in Type I, Type II, or Type III CRISPR/Cas systems, including but not limited to the CRISPR-associated complex for antiviral defense (Cascade, including a RAMP protein), Cas3 and/or Cas 7 (e.g., for Type I systems, such as Type I-E systems), Cas9 (formerly known as Csn1 or Csx12, e.g., such as in Type II systems), Csm (e.g., in Type III-A systems), Cmr (e.g., in Type III-B systems), Cas10 (e.g., in Type III systems), as well as subassemblies or sub-components thereof and assemblies including such Cas proteins or complexes. Additional Cas proteins and complexes are described in Makarova K S et al., "Evolution and classification of the CRISPR-Cas systems," Nat. Rev. Microbiol. 2011; 9:467-77, which is incorporated herein by reference in its entirety. Non-limiting examples of Cas proteins include Cas1, Cas1B, Cas2, Cas3, Cas4, Cas5, Cas6, Cas7, Cas8, Cas9 (also known as Csn1 and Csx12), Cas10, Cas12a, Cas12b, CasY, CasX, Cas13a, Cas13b, Cas13d, Cas14, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologs thereof, or modified versions thereof.

In some instances, the nuclease can include one or more mutations, with respect to a corresponding wild-type enzyme, such that the mutated CRISPR enzyme lacks the ability to cleave one or both strands of a target polynucleotide containing a target sequence (e.g., including one or more mutations, such as D10A, N580A, H840A, N854A, and/or N863A in SEQ ID NO:101 or in an amino acid sequence sufficiently aligned with SEQ ID NO:101). Other examples of mutations that render Cas9 a nickase include, without limitation, H840A, N854A, and N863A. In aspects of the invention, nickases may be used for genome editing via homologous recombination. The nuclease can include a nuclear localization sequence (NLS).

As a further example, two or more catalytic domains of Cas9 (RuvC I, RuvC II, and RuvC III) may be mutated to produce a mutated Cas9 substantially lacking all DNA cleavage activity. In some embodiments, a D10A mutation is combined with one or more of H840A, N854A, or N863A mutations to produce a Cas9 enzyme substantially lacking all DNA cleavage activity. In some embodiments, a CRISPR enzyme is considered to substantially lack all DNA cleavage activity when the DNA cleavage activity of the mutated enzyme is less than about 25%, 10%, 5%, 1%, 0.1%, 0.01%, or lower with respect to its non-mutated form. Other mutations may be useful; where the Cas9 or other CRISPR enzyme is from a species other than S. pyogenes, mutations in corresponding amino acids may be made to achieve similar effects.

Further exemplary nucleases are provided in FIGS. 15A-15F, 16A-16Q, 24A-24C, 27A-27D, 30A-30H, 33A-33C, 36A-36D, 39A-39B, 42A-42G, and 45A-45C. Such nucleases also include fragments of any sequence described therein, as well as substantially identical sequences of any described herein.

Labels and Quenchers

The target strands and/or non-target strands herein can include any useful label, including fluorescent labels and quencher labels at any useful position in the nucleic acid sequence (e.g., at the 3'-end, at an internal location between the 3'- and 5'-ends, appended to a nucleic acid as a side chain (e.g., a dT nucleic acid), inserted into the nucleic acid backbone (e.g., into the phosphate-pentose backbone), and/or at the 5'-end).

Exemplary fluorescent labels include a quantum dot, a fluorophore, etc. Examples of fluorescence labels include fluorescein, 6-FAM™ (Applied Biosystems, Carlsbad, Calif.), TET™ (Applied Biosystems, Carlsbad, Calif.), VIC™ (Applied Biosystems, Carlsbad, Calif.), MAX, HEX™ (Applied Biosystems, Carlsbad, Calif.), TYE™ (ThermoFisher Scientific, Waltham, Mass.), Yakima Yellow® (ELITech Group, Puteaux, France), TYE665, TYE705, TEX, JOE, Cy™ (Amersham Biosciences, Piscataway, N.J.) dyes (Cy2, Cy3, Cy3B, Cy3.5, Cy5, Cy5.5, Cy7), Texas Red® (Molecular Probes, Inc., Eugene, Oreg.), Texas Red-X, AlexaFluor® (Molecular Probes, Inc., Eugene, Oreg.) dyes (e.g., AlexaFluor 350, AlexaFluor 405, AlexaFluor 430, AlexaFluor 488, AlexaFluor 500, AlexaFluor 532, AlexaFluor 546, AlexaFluor 568, AlexaFluor 594, AlexaFluor 610, AlexaFluor 633, AlexaFluor 647, AlexaFluor 660, AlexaFluor 680, AlexaFluor 700, AlexaFluor 750), DyLight™ (ThermoFisher Scientific, Waltham, Mass.) dyes (e.g., DyLight 350, DyLight 405, DyLight 488, DyLight 549, DyLight 594, DyLight 633, DyLight 649, DyLight 755), ATTO™ (ATTO-TEC GmbH, Siegen, Germany) dyes (e.g., ATTO 390, ATTO 425, ATTO 465, ATTO 488, ATTO 495, ATTO 520, ATTO 532, ATTO 550, ATTO 565, ATTO Rho101, ATTO 590, ATTO 594, ATTO 610, ATTO 620, ATTO 633, ATTO 635, ATTO 637, ATTO 647, ATTO 647N, ATTO 655, ATTO 665, ATTO 680, ATTO 700, ATTO 725, ATTO 740), BODIPY® (Molecular Probes, Inc., Eugene, Oreg.) dyes (e.g., BODIPY FL, BODIPY R6G, BODIPY TMR, BODIPY 530/550, BODIPY 558/568, BODIPY 564/570, BODIPY 576/589, BODIPY 581/591, BODIPY 630/650, BODIPY 650/665), HiLyte Fluor™ (AnaSpec, Fremont, Calif.) dyes (e.g., HiLyte Fluor 488, HiLyte Fluor 555, HiLyte Fluor 594, HiLyte Fluor 647, HiLyte Fluor 680, HiLyte Fluor 750), AMCA, AMCA-S, Cascade® Blue (Molecular Probes, Inc., Eugene, Oreg.), Cascade Yellow, Coumarin, Hydroxycoumarin, Rhodamine Green™-X (Molecular Probes, Inc., Eugene, Oreg.), Rhodamine Red™-X (Molecular Probes, Inc., Eugene, Oreg.), Rhodamine 6G, TMR, TAMRA™ (Applied Biosystems, Carlsbad, Calif.), 5-TAMRA, ROX™ (Applied Biosystems, Carlsbad, Calif.), Oregon Green® (Life Technologies, Grand Island, N.Y.), Oregon Green 500, IRDye® 700 (Li-Cor Biosciences, Lincoln, Nebr.), IRDye 800, WellRED D2, WellRED D3, WellRED D4, and Lightcycler® 640 (Roche Diagnostics GmbH, Mannheim, Germany). In some embodiments, bright fluorophores with extinction coefficients>50,000 $M^{-1}$ $cm^{-1}$ and appropriate spectral matching with the fluorescence detection channels can be used.

In a specific embodiment, a fluorescently-labeled target strand and/or a fluorescently-labeled non-target strand is employed as a component of the cleavage substrate. Fluorophores include but are not limited to those described in Haughland, R. P., The Handbook, A Guide to Fluorescent Probes and Labeling Technologies, 10th Ed., 2005; Lakowicz, J. R., Principles of Fluorescence Spectroscopy, Springer, 3rd ed., 2006; 4-acetamido-4'-isothiocyanatostilbene-2,2' disulfonic acid; acridine and derivatives such as acridine and acridine isothiocyanate; 4-amino-N-[3-vinylsulfonyl)phenyl]naphthalimide-3,5 disulfonate, Lucifer Yellow VS; N-(4-anilino-1-naphthyl)maleimide; anthranilamide; Brilliant Yellow; BODIPY fluorophores (4,4-difluoro-4-bora-3a,4a-diaza-s-indacenes); coumarin and derivatives such as coumarin, 7-amino-4-methylcoumarin (AMC, Coumarin 120), 7-amino-4-trifluoromethylcoumarin (Coumaran 151); cyanosine; DAPDXYL sulfonyl chloride; 4',6-diaminidino-2-phenylindole (DAPI); 5',5"-dibromopyrogallol-sulfonephthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]naphthalene-1-sulfonyl chloride (DNS, dansyl chloride); 4-4'-dimethylaminophenylazo)benzoic acid (DABCYL); 4-dimethylaminophenylazophenyl-4'-isothiocyanate (DABITC); EDANS (5-[(2-aminoethyl)amino]naphthalene-1-sulfonic acid), eosin and derivatives such as eosin isothiocyanate; erythrosin and derivatives such as erythrosin B and erythrosin isothiocyanate; ethidium such as ethidium bromide; fluorescein and derivatives such as 5-carboxyfluorescein (FAM), hexachlorofluorescenin, 5-(4,6-dichlorotriazin-2-yl)aminofluorescein (DTAF), 2',7'-dimethoxy-4',5'-dichloro-6-carboxyfluorescein (JOE) and fluorescein isothiocyanate (FITC); fluorescamine; green fluorescent protein and derivatives such as EBFP, EBFP2, ECFP, and YFP; IAEDANS (5-({2-[(iodoacetyl)amino]ethyl}amino) naphthalene-1-sulfonic acid), Malachite Green isothiocyanate; 4-methylumbelliferone; orthocresolphthalein; nitrotyrosine; pararosaniline; Phenol Red; B-phycoerytnin; o-phthaldialdehyde; pyrene and derivatives such as pyrene butyrate, 1-pyrenesulfonyl chloride and succinimidyl 1-pyrene butyrate; QSY 7; QSY 9; Reactive Red 4 (Cibacron® Brilliant Red 3B-A); rhodamine and derivatives such as 6-carboxy-X-rhodamine (ROX), 6-carboxyrhodamine (Rhodamine 6G), rhodamine isothiocyanate, lissamine rhodamine B sulfonyl chloride, rhodamine B, rhodamine 123, sulforhodamine B, sulforhodamine 101 and sulfonyl chloride derivative of sulforhodamine 101 (Texas Red); N,N,N', N-tetramethyl-carboxyrhodamine (TAMRA); tetramethyl rhodamine; tetramethyl rhodamine isothiocyanate (TRITC); riboflavin; rosolic acid and terbium chelate derivatives.

Exemplary quencher labels include a fluorophore, a quantum dot, a metal nanoparticle, etc.). Suitable quenchers include Black Hole Quencher®-1 (Biosearch Technologies, Novato, Calif.), BHQ®-2, Dabcyl, Iowa Black® FQ or Iowa Black® RQ (Integrated DNA Technologies, Coralville, Iowa), IowaBlack RQ, QXL™ (AnaSpec, Fremont, Calif.), QSY 7, QSY 9, QSY 21, QSY 35, and IRDye QC. In one instance, the term "quencher" refers to a substance which reduces emission from a fluorescent donor when in proximity to the donor. Fluorescence is quenched when the fluorescence emitted from the fluorophore is detectably reduced, such as reduced by 10%, 20%, 30%, 40%, 50%, 60%, 70%, 80%, 90%, 95%, 99% or more. Numerous fluorophore quenchers are known in the art, including, dabcyl; sulfonyl chlorides such as dansyl chloride; ATTO quenchers (available from ATTO-TEC GmbH, Siegen, Germany), such as ATTO 540Q, ATTO 575Q, ATTO 580Q, and ATTO 612Q; and Black Hole Quencher® labels, such as BHQ®-0, BHQ®-1, BHQ®-2, and BHQ®-3.

Yet other quenchers include those that can be employed in a double-quencher format. Typically, FRET pairs include one fluorescent label at one end of a nucleic acid sequence and one quencher label at the other end. Depending on the length of the nucleic acid sequence, such distances can be about 20-30 bases, in which quenching efficiency is dependent on close proximity between the fluorescent and quencher labels (e.g., about 0.5 to 10 nm). To reduce background signal, internal quenchers can be employed, in which a quencher label is placed between the two ends of the probe. In this double-quencher format, three labels are employed: a first fluorescent label at one end of a nucleic acid sequence, a first quencher label at the other end of the nucleic acid sequence, and a second quencher label disposed between the first fluorescent label and the first quencher label. The second quencher can be provided at any useful location, e.g., within 15, 14, 13, 12, 11, 10, or 9 bases of the first fluorescent label. Exemplary internal quenchers can include ZEN™ quencher or TAO™ quencher (Integrated DNA Technologies, Inc., Coralville, Iowa).

In some instances, a label can be placed internally by employing phosphoramidite chemistry, e.g., thereby placing an internal label between the 5' and 3' pentose position in the phosphate-pentose chain. In other instances, a label can be placed within a sequence by employing modified nucleic acid amidite chemistry, e.g., thereby placing a label within the nucleic acid sequence, in which the label is appended as a side chain from a modified nucleic acid, such as deoxythymidine (dT).

Any detection method or system operable to detect a labeled reaction product can be used in methods according to embodiments of the present invention and such appropriate detection methods and systems are well-known in the art. A signal from the fluorescently labeled reaction product is detected, for instance, using a UV light source, a LED light source, a flashlight, etc., such as from a mobile device, a smartphone, or a fluorescence plate reader.

Additional examples of fluorophore/quencher pairs are known in the art, for instance, described in Lakowicz, J. R., Principles of Fluorescence Spectroscopy, Springer, 3rd ed., 2006; and Haughland, R. P., The Handbook, A Guide to Fluorescent Probes and Labeling Technologies, 10th Ed., 2005, which is incorporated herein by reference in its entirety.

Methods of Using a Cleavage Substrate

The present invention also relates to methods of using a cleavage substrate (e.g., any described herein) to determine nuclease activity. In some embodiments, the cleavage substrate facilitates high-throughput assay formats, which may be useful for understanding how a library of compounds (e.g., drugs, such as activators, inhibitors, small molecules, peptides, proteins, antibodies, affibodies, aptamers, vectors, particles, etc.) interact with the nuclease or how a library of different nucleases exhibit enzymatic activity for particular synthetic guiding components in use with the cleavage substrate.

Figure 5A:
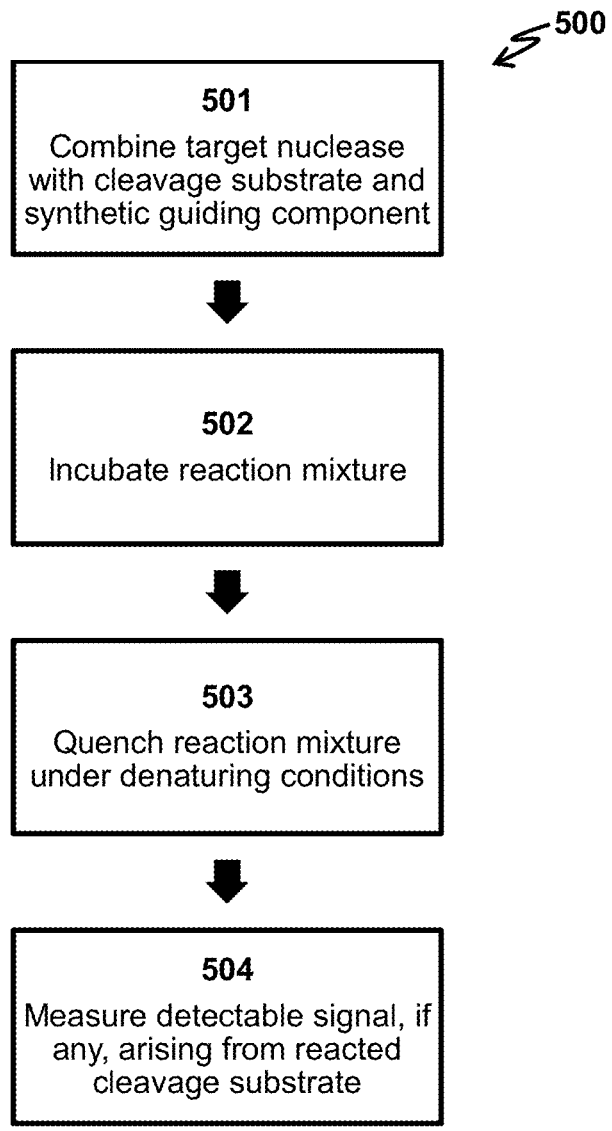
FIG. 5A-5B shows exemplary methods of detecting nuclease activity. Provided are (A) a schematic of a first non-limiting method 500 and (B) a schematic of a first non-limiting method 5000 for testing a drug.

FIG. 5A provides an exemplary method, e.g., for detecting or testing nuclease activity. The method 500 can include combining 501 a target nuclease with a cleavage substrate and a synthetic guiding component, thereby providing a reaction mixture; incubating 502 the reaction mixture, thereby providing an incubated reaction mixture; quenching 503 the incubated reaction mixture under a denaturation condition (e.g., configured to denature the target nuclease); and measuring 504 a detectable signal, if any, arising from a reacted cleavage substrate. For example, when a cleavage substrate having FRET labels are employed, then increased fluorescence signal of the fluorophore would indicate increased nuclease activity.

Such methods can be easily adapted to include a test compound (e.g., a drug) to determine the effect of that compound on nuclease activity, which can have implications for controlling and predicting genetic editing when employing a CRISPR-Cas system.

Figure 5B:
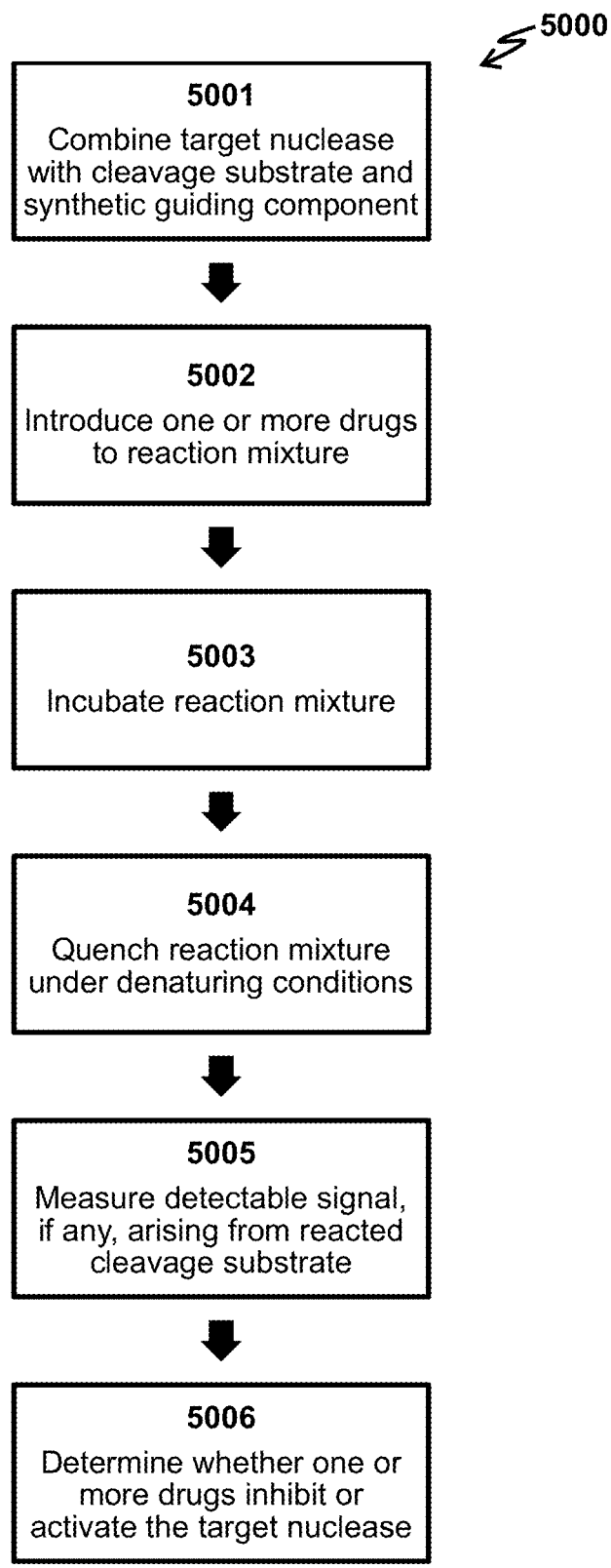

FIG. 5B provides an exemplary method, e.g., for testing a compound on its effect on nuclease activity. The method 5000 can include combining 5001 a target nuclease with a cleavage substrate and a synthetic guiding component, thereby providing a reaction mixture; introducing 5002 one or more compounds into the reaction mixture; incubating 5003 the reaction mixture, thereby providing an incubated reaction mixture; quenching 5004 the incubated reaction mixture under a denaturation condition (e.g., configured to denature the target nuclease); measuring 5005 a detectable signal, if any, arising from a reacted cleavage substrate; and determining 5006 whether one or more compounds inhibit or activate the target nuclease. The determining step can be conducted in any useful manner, e.g., comparing the signal arising from the reaction mixture including the compound with the signal from a control lacking that compound, in which an increased signal (as compared to control) indicates enhanced nuclease activity in the presence of the test compound and a decreased signal (as compared to control) indicates reduced nuclease activity in the presence of the test compound.

Any useful format can be employed to implement the methods herein. In one non-limiting method, a high-throughput array is employed to allow for high-throughput analysis of a library of nucleases or compounds. FIG. 6 provides an exemplary method, e.g., for testing a compound on its effect on nuclease activity. The method 6000 can include providing a drug array 601 in a multiwell format; introducing 6001 an assay mixture 602 to each drug within the well to form a reaction mixture 603, in which the assay mixture includes a target nuclease with a cleavage substrate and a synthetic guiding component; incubating 6002 the reaction mixture, thereby providing an incubated reaction mixture; quenching 6003 the incubated reaction mixture under a denaturation condition (e.g., configured to denature the target nuclease, such as by heating the array or by providing a quench reagent 604 to provide a quenched reaction mixture 605); and measuring 6004 a detectable signal, if any, arising from a reacted cleavage substrate (e.g., thereby determining whether one or more compounds inhibit or activate the target nuclease, as indicated by positive detection 606 of an increased signal (as compared to control) that indicates enhanced nuclease activity in the presence of the test compound or by negative detection 607 of a decreased signal (as compared to control) that indicates reduced nuclease activity in the presence of the test compound). If the array includes an array of nucleases, then the assay mixture can include a cleavage substrate and a synthetic guiding component.

Any useful denaturation conditions can be employed. In one instance, proteins (e.g., such as a nuclease) can be denatured by using an increased temperature (e.g., about 95° C. or of from about 60° C. to about 98° C.). In another instance, a chaotropic agent can be employed to disrupt interactions within the tertiary structure of the protein. Exemplary chaotropic agents include guanidinium, guanidine (e.g., of from about 6M to 8M), urea (e.g., of from about 6M to 8M), lithium perchlorate, formamide, sodium dodecyl sulfate, as well as salts thereof (e.g., guanidine hydrochloride or guanidinium chloride). In yet another instance, an alcohol (e.g., ethanol or isopropanol) can be employed to denature proteins.

Target Sites and Synthetic Guiding Components

Within a cleavage substrate, the target strand can include any useful nucleic acid sequence as the target site. In turn, the synthetic guiding component can be employed to recognize the target site, e.g., by employing a sequence that is complementary to the target site in the target sequence. The synthetic guiding component, with the Cas protein, can be employed to bind and/or cleave the target site of the target strand. Cleavage can include disruption of a single strand within the cleavage substrate or disruption of both strands.

In some instances, the target site is substantially complementary to the targeting portion. In other instances, the targeting portion of the synthetic guiding component and the complementary target site includes nucleic acid sequences that are substantially identical.

Any useful target site may be employed, so long as the target site is sufficiently complementary to the targeting portion. The sequence of target sites may be derived from known sequences of a subject. Exemplary target sites can include a sequence derived from a gene, e.g., a gene in which a mutation (e.g., a deletion, substitution, or insertion) has been identified to impart improper protein expression or regulation, such as, without limitation, AKT, BRCA1, BRCA2, BMD, CCR2, DMD, EGFR, EPM2A, Erb4, IGF, IGFR, IL-10, IL-13, IRAK1, Kras, Met, mGLUR5, MYBPC3, PRKCE, RAC1, VEGF, etc.

Yet other exemplary target sites can include a sequence derived from a bacterium, such as such as *Bacillus* (e.g., *B. anthracis*), Enterobacteriaceae (e.g., *Salmonella, Escherichia coli, Yersinia pestis, Klebsiella*, and *Shigella*), *Yersinia* (e.g., *Y. pestis* or *Y. enterocolitica*), *Staphylococcus* (e.g., *S. aureus*), *Streptococcus, Gonorrheae, Enterococcus* (e.g., *E. faecalis*), *Listeria* (e.g., *L. monocytogenes*), *Brucella* (e.g., *B. abortus, B. melitensis*, or *B. suis*), *Vibrio* (e.g., *V. cholerae*), *Corynebacterium diphtheria, Pseudomonas* (e.g., *P. pseudomallei* or *P. aeruginosa*), *Burkholderia* (e.g., *B. mallei* or *B. pseudomallei*), *Shigella* (e.g., *S. dysenteriae*), *Rickettsia* (e.g., *R. rickettsii, R. prowazekii*, or *R. typhi*), *Francisella tularensis, Chlamydia psittaci, Coxiella burnetii, Mycoplasma* (e.g., *M. mycoides*), etc.; an allergen, such as mycotoxins, mold spores, or bacterial spores such as *Clostridium botulinum* and *C. perfringens*; a toxin, such as ricin, mycotoxin, tetrodotoxin, anthrax toxin, botulinum toxin, staphylococcal entertoxin B, or saxitoxin; a virus, such as Adenoviridae (e.g., adenovirus), Arenaviridae (e.g., Machupo virus), Bunyaviridae (e.g., Hantavirus or Rift Valley fever virus), Coronaviridae, Orthomyxoviridae (e.g., influenza viruses), Filoviridae (e.g., Ebola virus and Marburg virus), Flaviviridae (e.g., Japanese encephalitis virus and Yellow fever virus), Hepadnaviridae (e.g., hepatitis B virus), Herpesviridae (e.g., herpes simplex viruses), Papovaviridae (e.g., papilloma viruses), Paramyxoviridae (e.g., respiratory syncytial virus, measles virus, mumps virus, or parainfluenza virus), Parvoviridae, Picornaviridae (e.g., polioviruses), Poxviridae (e.g., variola viruses), Reoviridae (e.g., rotaviruses), Retroviridae (e.g., human T cell lymphotropic viruses (HTLV) and human immunodeficiency viruses (HIV)), Rhabdoviridae (e.g., rabies virus), and Togaviridae (e.g., encephalitis viruses, yellow fever virus, and rubella virus)); a protozoon, such as *Cryptosporidium parvum, Encephalitozoa, Plasmodium, Toxoplasma gondii, Acanthamoeba, Entamoeba histolytica, Giardia lamblia, Trichomonas vaginalis, Leishmania*, or *Trypanosoma* (e.g., *T. brucei* and *T. cruzi*); a helminth, such as cestodes (tapeworms), trematodes (flukes), or nematodes (roundworms), e.g., *Ascaris lumbricoides, Trichuris trichiura, Necator americanus*, or *Ancylostoma duodenale*); a parasite (e.g., any protozoa or helminths described herein); a fungus, such as Aspergilli, Candidae, *Coccidioides immitis*, and Cryptococci; a pathogen; an environmental contaminant; a water additive; an agricultural marker; a nucleic acid (e.g., oligonucleotides, polynucleotides, nucleotides, nucleosides, molecules of DNA, or molecules of RNA, including a chromosome, a plasmid, a viral genome, a primer, or a gene of any useful pathogen, such as those described herein); or a genetic modification (e.g., antibiotic resistance marker gene). Targets also include food-borne pathogens, such as *Salmonella* (e.g., *Salmonella Typhimurium*), pathogenic *E. coli* (e.g., O157:H7), *Bacillus* (e.g., *B. cereus*), *Clostridium botulinum, Listeria monocytogenes, Yersinia* (e.g., *Y. enterocolitica*), Norovirus (e.g., Norwalk virus), *Shigella, Staphylococcus aureus, Toxoplasma gondii, Vibrio* (e.g., *V. vulnificus, V. cholera, V. parahaemolyticus*), *Campylobacter jejuni*, and *Clostridium perfringens*; and weaponized pathogens, such as *Bacillus anthracis, Yersinia pestis, Francisella tularensis, Brucella* (e.g., *B. suis*), *Burkholderia mallei, Burkholderia pseudomallei, Shigella, Clostridium botulinum*, Variola (e.g., *V. major*), Filoviridae (e.g., Ebola virus and Marburg virus), Arenaviridae (e.g., Lassa virus and Machupo virus), *Clostridium perfringens*, any food-borne pathogen (e.g., *Salmonella* species, *Escherichia coli* O157: H7, or *Shigella*), *Chlamydia psittaci, Coxiella burnetii, Staphylococcal aureus, Rickettsia* (e.g., *R. prowazekii* or *R. rickettsii*), Alphavirus (e.g., Venezuelan equine encephalitis virus, eastern equine encephalitis virus, or western equine encephalitis virus), *Vibrio cholerae, Cryptosporidium parvum*, Henipavirus (e.g., Nipah virus), Bunyaviridae (e.g., Hantavirus or Rift Valley fever virus), Flaviviridae (e.g., Japanese encephalitis virus and Yellow fever virus), and *Coccidioides* spp.

The test sample can include any useful sample, such as a microorganism, a virus, a bacterium, a fungus, a parasite, a helminth, a protozoon, a cell, tissue, a fluid, a swab, a biological sample (e.g., blood, serum, plasma, saliva, cerebrospinal fluid, etc.), a plant, an environmental sample (e.g., air, soil, and/or water), etc.

EXAMPLES

Example 1: Versatile High-Throughput Fluorescence Assay for Monitoring Cas9 Activity The RNA-guided DNA nuclease Cas9 is widely used for targeted modification of genomes from diverse organisms. Despite the extensive use of CRISPR systems for genome engineering and the rapid discovery and engineering of new CRISPR-associated nucleases, high-throughput assays for measuring enzymatic activity are lacking. The potential for accidental exposure or clinical off-target effects associated with the widespread use of CRISPR technology, underscore the need for therapeutically effective Cas9 inhibitors. Here, we describe a fluorescence assay for monitoring Cas9 nuclease activity and demonstrate its utility with *S. pyogenes, S. aureus*, and *C. jejuni* Cas9. The assay was validated by quantitatively profiling the species specificity of published anti-CRISPR (Acr) proteins. A screen of 189,606 small molecules with this assay resulted in six validated inhibitors of Cas9 endonuclease activity. The high-throughput nature of this assay makes it broadly applicable for the discovery of additional Cas9 inhibitors or the characterization of Cas9 enzyme variants.

Clustered regularly interspaced palindromic repeats (CRISPR) in the genomes of diverse prokaryotes and archaea combine with CRISPR-associated (Cas) proteins to provide immunity against pathogens. In the native context, Cas9 nuclease binds to a hybridized duplex of processed crRNA and trans-activating CRISPR RNA (tracrRNA) to generate a catalytically primed ribonucleoprotein (RNP) complex.[1] The Cas9 RNP surveilles DNA to identify a specific protospacer-adjacent motif (PAM) sequence (which is unique to each species' Cas system) to catalyze duplex unwinding and the formation of an R-loop between the target DNA strand and the 5' end of the crRNA.[2-4] If there is little complementarity between the RNA and DNA the substrate will be rejected without modification. If there is perfect or near-perfect complementarity between the crRNA and the target DNA strand, conformational changes in the Cas9 protein trigger endonuclease hydrolysis of the DNA by the HNH and RuvC active sites.[5, 6] Through this complex mechanism, Cas9 uses the sequence of a guide RNA species to cleave both strands of a targeted DNA.

The Cas9 enzyme from *S. pyogenes* (Spy) in combination with a single guide RNA (sgRNA, a combination of tracrRNA and crRNA in a single ~100 nucleotides (ntd) species) has been adapted for the editing of genomes in human cell lines[7-9] and diverse model organisms.[10-13] The introduction of Cas9 and sgRNA into cells results in targeted dsDNA breaks which can undergo error-prone repair through Non-Homologous End-Joining (NHEJ), disrupting the coding sequence of a gene and resulting in knockout.[14] Additionally, through the simultaneous addition of a homologous donor DNA, the Cas9-mediated dsDNA break can be repaired by Homologous Recombination (HR)[7] or Microhomology-Mediated End Joining (MMEJ)[15] to introduce a new sequence at the targeted locus.

Pre-clinical models have demonstrated the enormous potential of Cas9 to repair mutations associated with Duchenne Muscular Dystrophy[16-18] and various other genetic diseases.[19-26] Numerous viral and non-viral nanoparticle methods have been developed for the delivery of Cas9 with the potential for future human gene therapy use targeting somatic cells.[27] In addition, the unique properties of engineered Cas9 variants and Cas9 from additional bacterial species has greatly expanded the potential applications of CRISPR mediated genome engineering. The CRISPR toolbox now includes Cas9 endonucleases that recognize a variety of PAM sequences, have unique functionality (e.g., active at elevated temperatures, ability to target RNA and DNA, etc.), and are smaller in size allowing delivery by viral vectors with limited cargo space.[28-30]

Because of the risks associated with spurious off-target genome modifications, significant research has been done to understand the factors affecting the fidelity of Cas9 target DNA recognition and cleavage. Previous research has demonstrated that Cas9 fidelity can be increased by using a minimal length of sgRNA guide to limit the bound lifetime at off-target locations[31-33] or through the use of engineered Cas9 variants that are better able to kinetically discriminate mismatched targets.[5, 34-36] Reducing the lifetime of the Cas9 protein within the cell[37, 38] or the use of ligand binding domain-Cas9 fusions for allosterically-controlled activity[39-41] also have the potential to reduce off-target effects. An alternative method for temporal control of Cas9 activity is the sequential administration of a Cas9 inhibitor after RNP dosing, a technique that has been demonstrated to substantially reduce off-target modification in mammalian cells.[42] The development of Cas9 inhibitors, in addition to efforts to modify the Cas9 and sgRNA, are therefore valuable for ensuring the safety of CRISPR-based gene therapies and providing an antidote in the event of accidental exposure.

The screening of inhibitors of Cas9 activity is complicated: an inhibitor might act to prevent the guide RNA binding, DNA binding, or conformational changes that must occur prior to either cleavage event, thus blocking any DNA strand scission. Therefore, despite the intense research interest in Cas9 proteins, there is no high-throughput compatible activity assay that has been developed. Such an assay should be able to measure cleavage of a DNA substrate by Cas9 (ideally, differentiating double-stranded and nicking activity) with high sensitivity in microliter reaction volumes, using a minimum of reagents and processing steps. Molecular beacon-based binding assays have been used to study Cas9 binding to complementary and mismatched targets,[43, 44] but these are not able to report on DNA cleavage. Additional assays using cleavage-coupled DNA amplification[45, 46] or electrochemiluminescence signal generation[47] have also been reported, but these and simple gel electrophoresis-based assays are not compatible with high-throughput applications.

Here, we describe two designs of fluorophore/quencher-labeled DNA substrate oligonucleotides for monitoring Cas9 strand cleavage events. The optimal substrate design is agonistic to Cas9 DNA binding and is able to discriminate between the wild-type (wt) Cas9 and variants lacking either or both of the nuclease domains. We show that this assay can be adapted to different species of Cas9 by simply altering the PAM sequence. To implement the assay in high-throughput format, we miniaturized the reactions and carried out a 189,606-small molecule screen in low-volume 384-well format. The assay appears suitable for both the development of clinically-useful inhibitors and the rapid characterization of engineered Cas9 proteins with higher-fidelity[5, 34-36] or modified PAM sequences.[41, 49] Additional details follow.

Example 2: Experimental Materials and Methods

Chemicals, Substrates, and Plasmids: All reagents were from Fisher BioReagents unless otherwise noted. Bovine serum albumin (BSA), magnesium chloride, polyethylenimine (PEI), and guanidine-hydrochloride (Gdn-HCl) were from Sigma-Aldrich. Ultrapure RNase/DNase-free water and ethylenediaminetetraacetic acid (EDTA) were from Invitrogen. Tris(2-carboxyethyl)phosphine (TCEP), dithiothreitol (DTT), and isopropyl j-D-1-thiogalactopyranoside (IPTG) were from Gold Biotechnology. Carbenicillin and kanamycin were from Teknova. Protease inhibitors were from Pierce Biotechnology. The FDA-approved inhibitor hit compound restocks were purchased from MedChemExpress. The fluorophore/quencher deoxyoligonucleotides were ordered HPLC-purified from Integrated DNA Technologies (IDT). Table 2 lists the sequences of all oligonucleotides.

TABLE 2

Sequences of oligonucleotides and relevant portions of plasmids*

| Name | Sequence (5' to 3') | SEQ ID NO: |
|---|---|---|
| Spy Cas9 "same-strand" target | AGC AAG CTG ACG TTT GTA CTC CAG CGT CTC ATC TTT ATG CGT CAG CAG AGA TTT CTG CTG TGC | 1 |
| Spy Cas9 "same-strand" non-target | GCA CAG CAG AAA TCT CTG CT G ACG CAT AAA GA/iCy5N/ GAG ACG CTG GAG /TAO/ACA AAC GTC AGC /3IAbRQSp/ | 2 |

TABLE 2-continued

Sequences of oligonucleotides and relevant portions of plasmids*

| Name | Sequence (5' to 3') | SEQ ID NO: |
|---|---|---|
| Spy Cas9 "opposite-strand" target | /5Cy5/TGT ACT CCA GCG TCT CAT CTT TAT GCG TCA GCA GAG ATT TCT GCT GTG C | 3 |
| Spy Cas9 "opposite-strand" non-target | GCA CAG CAG AAA TCT CTG CTG ACG CAT AAA GAT GAG ACG CTG GAG TA/3IAbRQSp/ | 4 |
| Sau Cas9 "opposite-strand" target | Same as Spy sequence | |
| Sau Cas9 "opposite-strand" non-target | Same as Spy sequence | |
| Cje Cas9 "opposite-strand" target | /5Cy5/TCC GTG TTC ACG CGT CTC ATC TTT ATG CGT CAG CAG AGA TTT CTG CTG TGC | 5 |
| Cje Cas9 "opposite-strand" non-target | GCA CAG CAG AAA TCT CTG CTG ACG CAT AAA GAT GAG ACG CGT GAA CAC G/3IAbRQSp/ | 6 |
| Spy Cas9 FAM target | GCA AAC ATG AGG TCG CAG AGT AGA AAT ACG CAG TCG TCT CTA AAG ACG AC | 7 |
| Spy Cas9 Fam non-target | TCA CAG CAG AAA TCT CTG CTG ACG CAT AAA GAT GAG ACG CTG GAG TAC AAA CGT CAG CTT GCT | 8 |
| Spy sgRNA transcription plasmid insert | <u>TAATACGACTCACTATA</u>*GACGCATAAAGATGAGACGC*GTTTTAGAGCTAG AAATAGCAAGTTAAAATAAGGCTAGTCCGTTATCAACTTGAAAAAGTG GCACCGAGTCGGTGCTTTTTTGAATTC | 9 |
| Sau sgRNA transcription plasmid insert | <u>TAATACGACTCACTATA</u>*GCTGACGCATAAAGATGAGACGC*GTTTTAGTACT CTGGAAACAGAATCTACTAAAACAAGGCAAAATGCCGTGTTTATCTGT CAACTTGTTGGCGAGATGAATTC | 10 |
| Cje sgRNA transcription plasmid insert | <u>TAATACGACTCACTATA</u>*GCTGACGCATAAAGATGAGACGC*GTTTTAGTCCC TGAAAAGGGACTAAAATAAAGAGTTTGCGGGACTCTGCGGGGTTACAA TCCCCTAAAACCGCGAATTC | 11 |

*<u>Underlined</u> sequence is the T7 Promoter
*<em>Italicized</em> sequence is the target of the sgRNA
*Bold is the EcoRI site used for linearization and production of run-off transcripts The plasmids for the bacterial production of S. pyogenes (Spy) wt, D10A, H840A, and dead Cas9 (Addgene plasmids 39312, 39315, 39316, 39318)[1] and S. aureus (Sau) Cas9[50] as His-MBP-TEV protease site fusions were gifts from Jennifer Doudna. The NLS-Cas9-His$_6$ plasmid was a gift from David Liu (Addgene plasmid 62934).[51] The C. jejuni (Cje) Cas9 plasmid was a gift from Seokjoong Kim (Addgene plasmid #89754).[30] The plasmid for the bacterial production of AcrIIA4 was generated in a modified pTXB1 plasmid backbone (with a C-terminal His$_6$ tag after the chitin-binding domain) by standard restriction enzyme cloning. The plasmid for the production of AcrIIC1 was generated by modification of Addgene plasmid #39312, replacing the Cas9 gene with AcrIIC1.

In Vitro Transcription of sgRNA: The Spy/Sau/Cje sgRNA were produced by run-off transcription from a linearized plasmid using the NEB HiScribe High Yield T7 RNA Synthesis Kit. The RNA was purified with a Qiagen RNeasy Maxi kit according to manufacturer specifications. The RNA concentration was determined by A260.

Purification of S. pyogenes Cas9 and variants: The Cas9 plasmid was transformed into E. coli BL21(star)DE3, grown to an $OD_{600}$ of µ0.5, induced with 0.25 mM IPTG and grown at 20° C. for an additional 20 hours. The pellets were lysed in buffer A [50 mM Tris-HCl pH 7.5, 500 mM NaCl, 0.5 mM TCEP, 10% glycerol] containing Pierce protease inhibitor tablets by passage through an Avestin EmulsiFlex-C5 homogenizer. The lysate was clarified, passed through a Ni-NTA column, and eluted with a linear gradient of 10 to 500 mM imidazole in buffer A. The eluted protein was dialyzed overnight against 1 L of buffer [20 mM HEPES pH 8, 200 mM KCl, 0.5 mM TCEP, 10% glycerol] in the presence of ⅓₀th mass of TEV protease. MacroPrep High S cation exchange chromatography was performed with a linear gradient of low salt buffer [20 mM HEPES pH 8, 100 mM KCl, 0.5 mM TCEP, 10% glycerol] to high salt buffer [20 mM HEPES pH 8, 1000 mM KCl, 0.5 mM TCEP, 10% glycerol]. The eluted protein was passed through a 5 mL Ni-NTA column and the flow-through was collected, concentrated, and exchanged into storage buffer [20 mM HEPES pH 8, 150 mM KCl, 1 mM TCEP, 20% glycerol]. It was flash frozen and stored at −80° C.

Purification of S. aureus and C. jejuni Cas9: The same procedure was performed as above, except the clarified lysate was adjusted to 0.2% PEI by dropwise addition from a 10% stock (pH 7) on ice. After 30 minutes, the precipitated nucleic acid was pelleted at 50,000 g for 30 minutes at 4° C. The supernatant was collected and adjusted to 50% saturated ammonium sulfate on ice. After 30 minutes, the protein precipitate was pelleted at 50,000 g for 30 minutes at 4° C. The pellet was resuspended and purified through Ni-NTA and cation exchange chromatography as described above. The eluted protein was concentrated in high salt buffer and purified by an Enrich SEC 650 column. The protein-containing fractions from the SEC column were pooled and exchanged into storage buffer, then flash frozen and stored at −80° C.

Purification of AcrIIA4: The plasmids were transformed into E. coli BL21(star)DE3, grown, and lysed as described above. The clarified lysate containing AcrIIA4 was passed through a 5 mL Ni-NTA column and eluted with a linear gradient of 10 to 500 mM imidazole in low salt buffer A [50 mM Tris-HCl pH 7.5, 100 mM NaCl, 0.5 mM TCEP, 10 mM imidazole]. The eluted protein was adjusted to 100 mM DTT and incubated at 4° C. to promote cleavage of the CBD-His tag. AcrIIA4 was separated from the tag by a 5 mL MacroPrep High Q anion exchange chromatography step with a linear gradient of low salt [20 mM HEPES pH 8, 100 mM KCl, 0.5 mM TCEP] to high salt buffer [20 mM HEPES pH 8, 1000 mM KCl, 0.5 mM TCEP]. The eluted protein was concentrated, exchanged into buffer [20 mM HEPES pH 8, 100 mM KCl, 0.5 mM TCEP], flash frozen and stored at −80° C.

Purification of AcrIIC1: The plasmid was transformed into E. coli BL21(star)DE3, grown, and lysed as described above. The clarified lysate containing AcrIIC1 was passed through a 5 mL Ni-NTA column and eluted with a linear gradient of 10 to 500 mM imidazole in buffer A. The eluted protein was dialyzed in the presence of $\frac{1}{30}^{th}$ mass of TEV protease against buffer A overnight at 4° C. The cleaved AcrIIC1 was separated from the tag and TEV protease by two passes through a 5 mL Ni-NTA column. The flow-through was concentrated and exchanged as with AcrIIA4.

Fluorescence Assays for Cas9: Reactions (50 µL) were set up in Cas9 reaction buffer [20 mM Tris-HCl pH 7.5, 100 mM NaCl, 5 mM MgCl$_2$, 0.1 mM EDTA] containing 50 nM annealed DNA substrate, 1 µM sgRNA, and 2 µM Cas9 in the wells of a black 384-well plate. The reactions were incubated for 1 hour at ambient temperature, then 50 µL of 8 M Gdn-HCl was added to quench the reaction. For Spy Cas9 this was sufficient to denature the protein and release the cleaved DNA product. For Sau and Cje Cas9 the plates were covered with an aluminum seal and incubated at 55° C. for 1 hour before reading. The fluorescence was read in a Tecan Infinite M1000 or M200 Pro plate spectrofluorometer.

Anti-CRISPR Profiling Against Spy, Sau, and Cje Cas9: Reactions (50 µL) were set up in Cas9 reaction buffer [20 mM Tris-HCl pH 7.5, 100 mM NaCl, 5 mM MgCl$_2$, 0.1 mM EDTA] containing 30 nM annealed DNA substrate, 0.4 µM sgRNA, and 0.2 µM Cas9 in the wells of a black 384-well plate. The reactions were incubated for 1 hour at ambient temperature with the indicated concentration of anti-CRISPR protein, then 50 µL of 8 M Gdn-HCl was added to quench the reaction. The plates were covered with an aluminum and incubated at 55° C. for 1 hour before reading on a Tecan Infinite M200 Pro plate spectrofluorometer.

Purification of NLS-Cas9-His$_6$ in High-Throughput Scale: The NLS-Cas9-His$_6$ construct used for the high-throughput screening was purified in 4 to 8 L growth batches through Ni-NTA affinity chromatography as described, then flash-frozen and stored at −80° C. Once sufficient material was obtained, the batches were thawed, pooled, and purified by a 50 mL MacroPrep High S Cation Exchange column, washed with low salt buffer [20 mM HEPES pH 8, 100 mM KCl, 0.5 mM TCEP, 10% glycerol] and eluted in high salt buffer [20 mM HEPES pH 8, 1000 mM KCl, 0.5 mM TCEP, 10% glycerol]. The eluted protein was diluted with glycerol to adjust the final concentration to 40% (approximately 50 µM protein concentration), flash frozen, and stored at −80° C.

High-Throughput Screening Protocol: HTS buffer [20 mM Tris-HCl pH 7.5, 100 mM NaCl, 5 mM MgCl$_2$, 0.1 mM EDTA, 1 mM TCEP, 0.5% Bovine Serum Albumin (BSA)] was dispensed into low-volume black 384 well plates (Greiner Bio-One #784076) with 5 µL/well. 100 nL of compounds in DMSO (1 mM) from the UCLA Molecular Screening Shared Resource were pinned into the wells. Columns 2 and 23 contained only DMSO. The plates were sealed and stored at 4° C. for 1 to 4 days before assay. NLS-Cas9-His$_6$ (0.667 µM) and sgRNA (1.33 µM) were combined in HTS buffer, and 3 µL was dispensed into the wells (from a BioTek EL406 equipped with a 1 µL cassette) and incubated for 30 to 60 minutes. Annealed duplex reporter substrate (10 µM) was diluted to 150 nM in HTS buffer and reactions were initiated by dispensing 2 µL into each well. After 20-30 minutes, the reactions were quenched by dispensing 10 µL of 8 M Gdn-HCl. The fluorescence was measured on a Tecan Infinite M1000 with: 10 second shake using a linear amplitude of 2 mm, excitation wavelength: 624 nm (band width 8 nm), emission wavelength: 680 nm (band width 8 nm), maximal gain, Z-position: 25570 µM. All other settings were left at default. The fluorescence data were normalized relative to the positive and negative controls in the same rows to give a fractional fluorescence of the controls for each well/compound.

Denaturing Gel Electrophoresis Secondary Assay: The 5' FAM target 50mer and 5' FAM non-target 63mer oligonucleotides were purified by denaturing PAGE, and annealed at 10 µM. Reactions were performed as above, except that the dual FAM-labeled substrates were used. After 20 minutes, the reactions were quenched by the addition of one volume of 2× formamide loading buffer and were heated to 95° C. for 10 minutes to denature the substrate strands and analyzed by denaturing 8M urea 20% polyacrylamide gel. The gels were imaged for FAM fluorescence by a ProteinSimple FluorChem R imaging system. ImageJ[52] was used to analyze the intensity of the intact and cut bands and ratiometric quantitation was performed.

Example 3: Comparison of Fluorescent Cas9 Assay Designs

To facilitate high-throughput screening of Cas9 variants with unique activity requirements[5, 34-36, 48, 49] and/or inhibitors of Cas9,[42] we sought to develop a simple, high-throughput Fluorescence Resonance Energy Transfer (FRET)-based assay for monitoring Cas9 activity. We designed two variants of fluorophore/quencher-labeled DNA substrates: a "same-strand" variant in which a Tao/IowaBlack dual quencher and an internal Cy5 fluorophore are located on either side of the cleavage site in the non-target strand (FIG. 7A) and an "opposite-strand" variant in which a 5' end-labeled Cy5 target strand is hybridized with a 3' IowaBlack end-labeled non-target strand (FIG. 7B). Both were based on a Spy Cas9 target sequence that has been extensively studied through single-molecule spectroscopy.[4] The use of a dual quencher substrate was based on previous reports of lower background and higher sensitivity from this arrangement in long quantitative PCR probes[53]

Cas9, by virtue of extensive electrostatic interactions and the base-pairing between the bound guide RNA and the target DNA sequence, remains extremely tightly bound to its product even after cleavage.[54] The tight binding of Cas9 RNP to the product DNA prevents enzymatic turnover (under in vitro conditions) and release of the cleaved fragments and thus inhibits signal generation from the dissociation of fluorophore quencher pairs. To overcome this limitation, we assayed the substrates both under native conditions in buffer and after the addition of 4M guanidine-hydrochloride (Gdn-HCl) to denature the protein. For the "same-strand" substrate the addition of either wild-type (wt) or nuclease-inactivated dead (dCas9) variants of Cas9 produced a significant increase in fluorescence in the native context (FIG. 7C, left). The fluorescence increase was identical regardless of catalytic nuclease activity indicating that the simple binding of Cas9 and unwinding of the substrate is sufficient to produce a three-fold increase in sign signal. However, after denaturation of Cas9 to force the release of the bound DNA, there was a two-fold increase in fluorescence with wt Cas9 in comparison to dCas9 or no Cas9 (FIG. 7C, right). For the "opposite-strand" substrate, the binding of Cas9 alone does not produce any increase in fluorescence (FIG. 7D, left). However, when a denaturing quench was added after the reaction, the wt Cas9-treated wells were approximately 10-fold higher in fluorescence than either the no Cas9 or dCas9 controls (FIG. 7D, right). The large increase in signal for this substrate provides a large window for measuring changes/differences in Cas9 cleavage activity.

Another unique aspect of the Cas9 enzyme is its concerted use of two discrete and non-homologous nuclease domains to cleave both strands of a DNA substrate. Therefore, the RuvC or HNH nuclease domains could be inhibited in isolation, blocking just one of the two DNA strand scission reactions. To determine if these two substrate designs can distinguish double stranded cleavage from cleavage of each strand in isolation, we purified and tested the D10A (RuvC KO) and H840A (HNH KO) variants of Cas9. When the reactions were quenched with Gdn-HCl, the "same-strand" substrate showed no increase in fluorescence with the D10A, H840A, or dead Cas9 (FIG. 7E). This is consistent with the fact that both strands must be cleaved to separate the internal Cy5 from the pair of quenchers (FIG. 7A).

Interestingly, with the "opposite-strand" substrate both the D10A and H840A showed a partial increase in fluorescence, four-to-six-fold, as opposed to the ten-fold increase in signal obtained upon addition of wt Cas9 (FIG. 7F). To eliminate the possibility that this partial fluorescence increase stems from incomplete digestion of the target/non-target strand by the D10A/H840A nickase mutants, we used a dual 5' FAM-labeled substrate and denaturing polyacrylamide gel electrophoresis (PAGE) to ensure that the reactions went to completion in all cases (FIG. 8A). Under identical conditions as the above reactions, the PAGE substrate showed complete digestion of the target strand (for RuvC KO), non-target strand (for HNH KO), or both strands (for the wt) (FIG. 8B). The "opposite-strand" substrate therefore shows a large increase in fluorescence upon cleavage of both strands, a partial increase upon cleavage of either strand in isolation, and no increase in fluorescence upon the binding of dCas9 alone. These attributes make it ideal for high-throughput screening for inhibitors of Cas9 nuclease activity. Thus, this substrate was selected for further development.

Example 4: Adaptation of the Cas9 Assay for Alternative Species

Initial experiments were performed with the well-characterized Spy Cas9. Although Spy Cas9 is the most widely used Cas9 for genome editing, its large size (4.1 kb) prevents it from being packaged with its sgRNA into the efficient in vivo delivery vector, adeno-associated virus (AAV).[55] As an alternative, researchers have turned to two smaller Cas9 orthologues with genome editing capabilities, S. aureus (Sau) Cas9 (3.16 kb), and C. jejuni (Cje) Cas9 (2.95 kb), that can be packaged together with their sgRNA into an AAV vector for efficient in vivo delivery. These orthologues are also gaining interest from the research community due to recent publications that indicate these two endonucleases are capable of PAM-independent RNA targeting.[50, 56]

To broaden the assay to identify inhibitors of these enzymes and demonstrate its versatility for diverse Cas9 PAM sequences, we characterized FRET substrates for Sau and Cje Cas9. The Spy and Sau Cas9 PAM sequences are partially overlapping and complementary such that the same substrate can be used for both enzymes (FIG. 9). For Cje Cas9, the PAM sequence is unique and due to its increased length, the length of the target and non-target strands must be increased to accommodate the additional nucleotides (FIG. 9). These substrates were incubated with Sau Cas9 or Cje Cas9 and the corresponding sgRNA under the same conditions as used in FIG. 7D for Spy Cas9. However, because of the increased thermostability of the Sau/Cje Cas9 enzymes and/or the longer DNA substrate, an additional 1 hour incubation at 55° C. incubation was required after the addition of 4 M Gdn-HCl, for DNA substrate release. With this additional quenching step, the fluorescence values obtained from Sau and Cje Cas9 with their respective substrates were nearly identical to that obtained with Spy Cas9 (FIG. 10). The lack of fluorescence increase in the absence of sgRNA confirms that these protein preparations are free of nonspecific contaminating nuclease. These assays developed for Spy, Sau, and Cje Cas9 demonstrate that our assay's approach can be generalized, by simply designing substrates for other species' Cas9 enzymes.

Example 5: Profiling the Species Specificity of Anti-CRISPRs (Acrs)

To evaluate the ability of the Spy, Sau, and Cje Cas9 cleavage assays to quantitatively measure changes in activity, we used published phage-derived anti-CRISPR proteins AcrIIA4 and AcrIIC1 for validation. AcrIIA4 was discovered as a Spy Cas9 inhibitor,[57] and has since been shown to inhibit Spy Cas9 by binding to RNP competitively with PAM-interacting and non-target DNA strand cleavage catalytic pockets.[42] AcrIIC1 was reported as a more broad-spectrum Cas9 inhibitor that works against several species, including Cje, but not Spy.[51, 59]

Figure 11B:
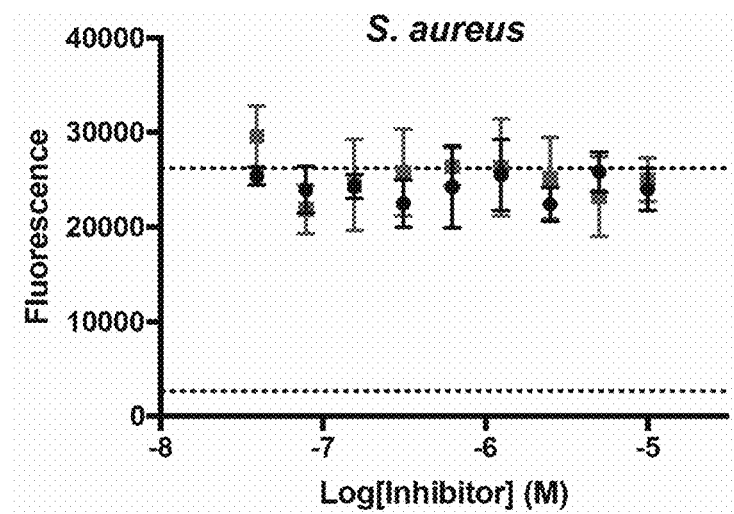

To measure AcrIIA4 and AcrIIC1 efficacy and specificity, varying concentrations of inhibitor protein were added to reactions measuring the activity of Spy, Sau, and Cje Cas9 on a single 384-well plate. As expected from published results, AcrIIA4 shows extremely potent inhibition of Spy Cas9 (<30 nM, below the active Cas9 concentration required for this assay) (FIG. 11A). AcrIIC1 did not show any detectable inhibition of Spy Cas9 out to 10 µM (FIG. 11A). Sau Cas9, which had not been previously tested against either anti-CRISPR, was not inhibited by AcrIIA4 or AcrIIC1 out to a 10 µM concentration (FIG. 11B). Cje Cas9 was inhibited by AcrIIC1 and not by AcrIIA4, as expected.

Figure 11C:
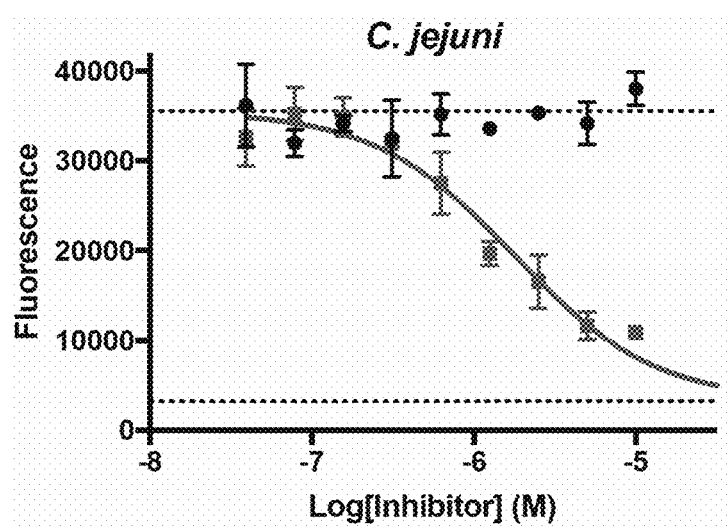

However, the inhibition by AcrIIC1 was fairly weak with an $IC_{50}=1.8\pm0.4$ μM (FIG. 11C). These results are entirely consistent with what was expected based on the literature reports, and demonstrate the utility of these methods for characterizing the efficacy, species specificity, and relative potency of anti-CRISPR proteins.

Example 6: Development of the High-Throughput Screening Format

Figure 12A:
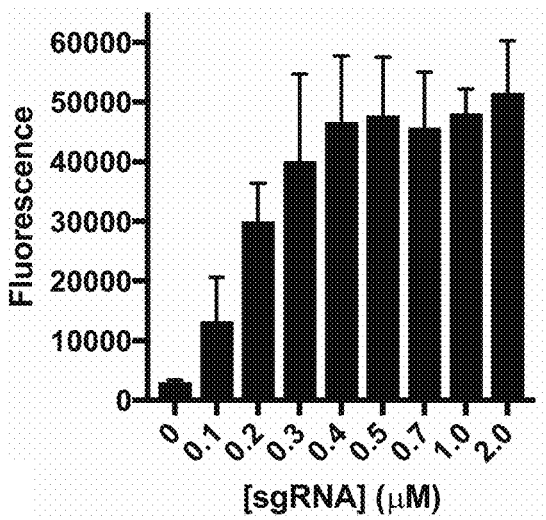
FIG. 12A-12D shows results from a high-throughput Cas9 FRET assay. (A) The fluorescence of reactions containing fixed 30 nM DNA and 500 nM Spy Cas9 and the indicated concentration of guide RNA. (B) The fluorescence of reactions containing fixed 30 nM DNA, with or without 1000 nM Spy sgRNA, and the indicated concentration of Spy Cas9 after the addition of quench. (C) The fluorescence values of a control plate of miniaturized (10 µL) reactions. (D) A time course for the Cas9 reaction on the FRET substrate with 30 nM DNA, 200 nM Cas9, and 400 nM sgRNA. The reactions were quenched at the indicated time by addition of 4 M Gdn-HCl. For A, B, and D data are the average and standard deviation of three replicate wells. For C, each group consists of 192 replicates.
Figure 12B:
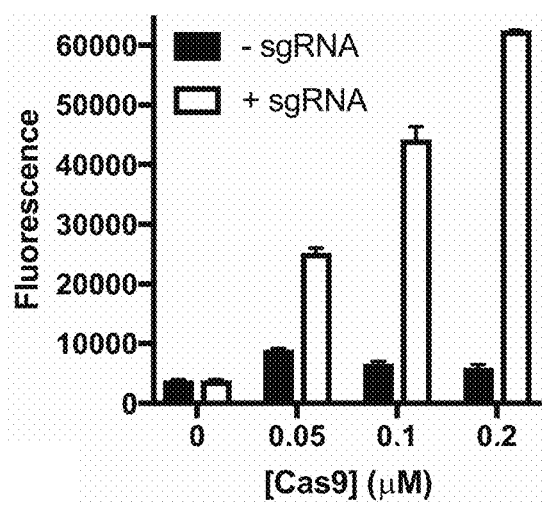

To reduce reagent use and costs associated with high-throughput screening we sought to identify the minimal concentrations of all reactants required for a robust signal change. Because Cas9 follows single-turnover kinetics, a titration of Cas9 and sgRNA under endpoint conditions can determine the minimal amount sufficient for complete digestion of substrate. For a fixed 30 nM concentration of DNA substrate, a titration of sgRNA (with saturating 500 nM Cas9) (FIG. 12A) and a titration of Cas9 (with and without saturating 1000 nM sgRNA) (FIG. 12B) identified the minimal concentrations of each for a complete reaction. The lack of signal change from Cas9, even at the highest concentration, in the absence of sgRNA confirms that there is no nonspecific nuclease activity from this preparation.

Figure 12C:
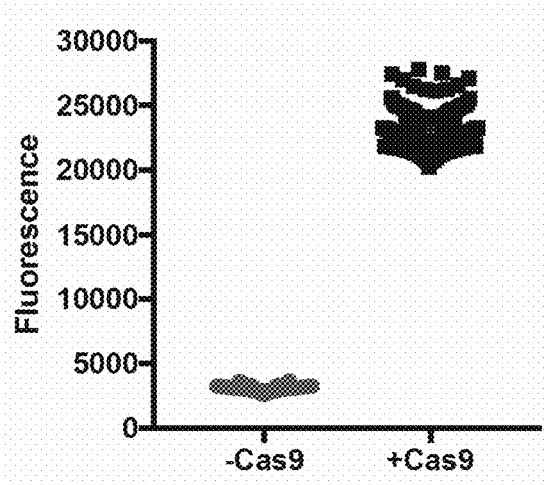

From these results 30 nM DNA, 200 nM Cas9, and 400 nM sgRNA were selected. These reaction conditions were then adapted from a 50 μL reaction volume in standard 384-well plates to a 10 μL reaction volume in low-volume 384 well-plates. As validation of assay quality the variance around the positive (no inhibitor) and negative controls (without Cas9 RNP) was low and the large signal change between the two was maintained in the low-volume format as indicated by an excellent assay Z-factor (Z') of 0.755 (FIG. 12C).[60]

Figure 12D:
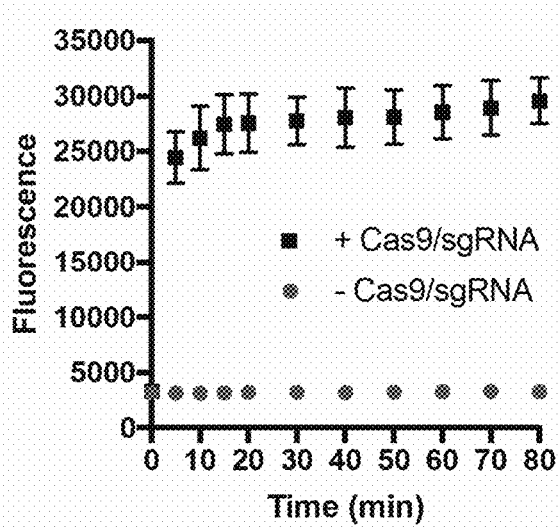

To determine the optimal reaction time before the addition of the Gdn-HCl quench, a time course for the Cas9 nuclease activity was performed (FIG. 12D). These results are consistent with the reaction profile that would be expected from a single-turnover enzyme such as Cas9. Although the reaction is ~95% complete by 5 minutes, a 20 to 30 minute reaction time was selected as the minimal time that is practical for a HTS application. The use of a minimal reaction time is beneficial for the detection of reversible inhibitors under single-turnover conditions.

Example 7: Screening a Small Molecule Library for Cas9 Inhibitors

Figure 13A:
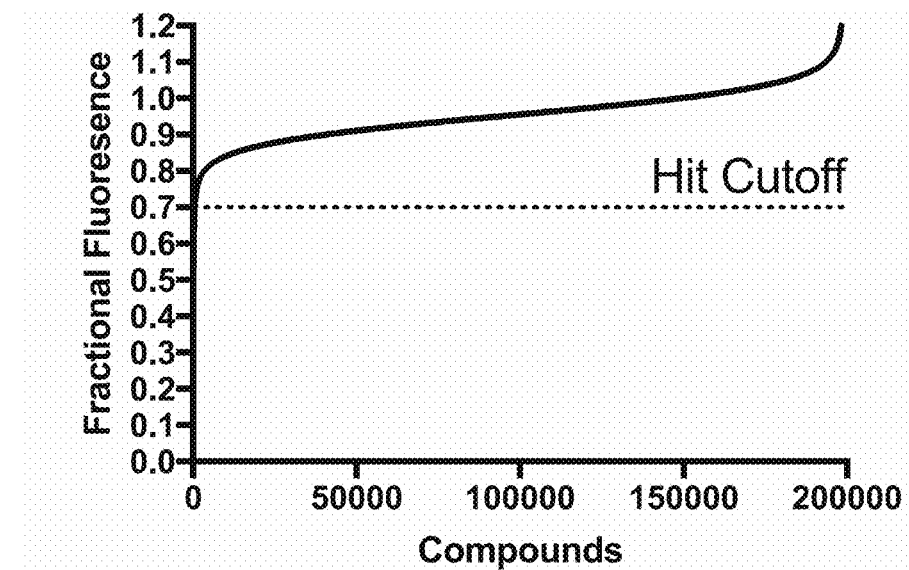
FIG. 13A-13E shows results from a high-throughput screen for small-molecule Cas9 inhibitors. (A) The normalized fluorescence of 200,280 compounds (189,606 non-redundant) screened using the optimized low-volume protocol. (B) All the compounds below the hit cutoff of 0.7× of the controls are shown in detail. (C) From the positive (DMSO-treated Cas9 RNP) and negative (No Cas9 RNP) controls on each plate, the Z' was calculated. The average and standard deviation of the Z' values across the 630 screened plates are plotted. (D) The compiled results from denaturing PAGE secondary assays of the 437 hits identified in the primary screen. From the gel images, the relative activity of the HNH and RuvC domains were calculated and plotted along with the corresponding primary assay data. The circle indicates the hit compounds that were confirmed in the secondary assay. (E) The PAGE gels showing the inhibition of Cas9 activity by the 6 confirmed hits. The negative control shows the uncleaved non-target and target strands (from top to bottom), while the positive control shows predominantly cleaved target and non-target strands (from top to bottom).
Figure 13B:
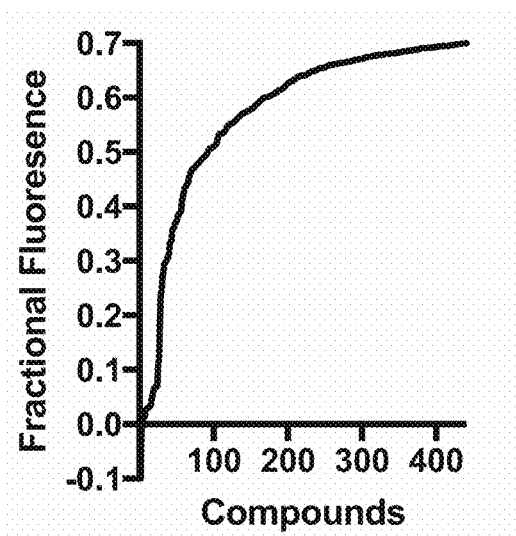
Figure 13C:
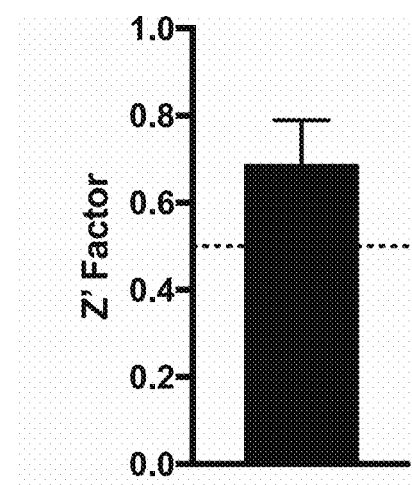

With the assay developed and optimized for HTS, we performed a screen of 189,606 non-redundant small molecules supplied by the UCLA Molecular Shared Screening Resource using 630 low-volume 384-well plates, and the fluorescence signal was normalized to positive and negative controls on each plate (FIG. 13A). The signal is decreased approximately 50% by inhibition of either of the two nuclease domains in isolation (see FIG. 7F) so a hit cutoff of 0.7× fluorescence of controls was used to correspond to either 30% inhibition of both nuclease domains or 60% inhibition of a single nuclease domain. By this definition 437 hit compounds (0.2% of the total) were obtained for further testing (FIG. 13B). The Z' factors calculated from the positive and negative controls on each plate showed an average value of 0.689, with >95% of plates having a Z'>0.5, the cutoff for an excellent assay[67] (FIG. 13C).

Figure 13D:
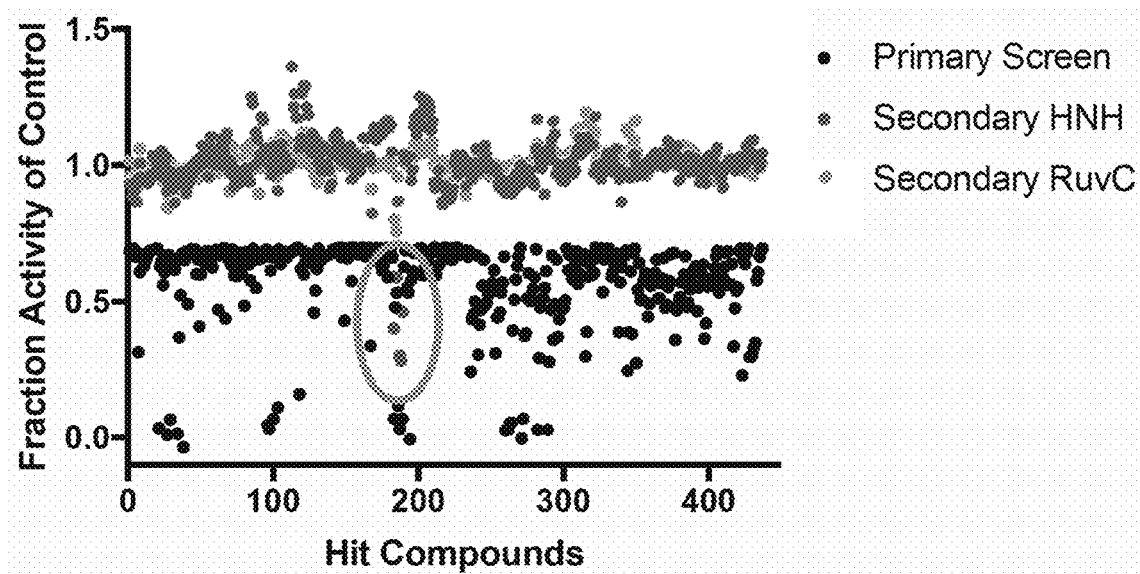
Figure 13E:
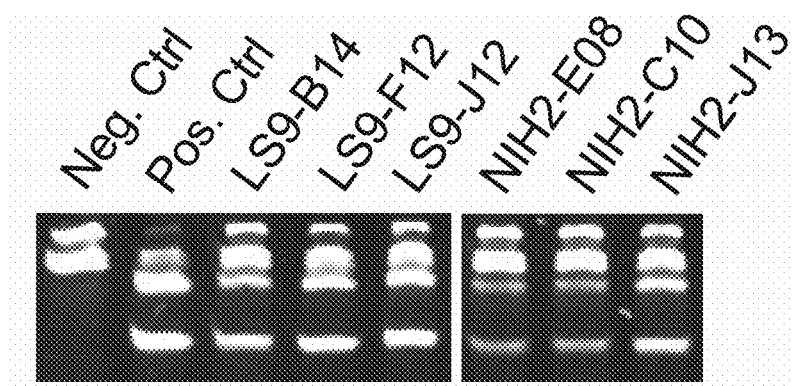

To confirm the 437 hits and directly measure the inhibition of the both the RuvC and HNH nuclease domains individually, each hit was screened with the above-described PAGE assay. The gel results were quantitated by densitometry and the fractional RuvC and HNH nuclease activity of controls were calculated and plotted along with the fractional fluorescence of the same compound in the primary screen (FIG. 13D). The majority of the compounds do not produce significant (>0.3×) inhibition in this direct secondary assay, but there were 6 hit compounds that had <0.7× the signal of the controls for either RuvC or HNH cleavage (or both). These data points are highlighted with the circle on FIG. 13D. The polyacrylamide gel image for these compounds show clear inhibition Cas9 cleavage activity, with the two domains inhibited to varying degrees (FIG. 13E). Unfortunately, cytotoxicity studies with these 6 confirmed inhibitors showed near-complete cell killing at 10 μM after 48 hours (FIG. 14). Thus, although the assay did perform as expected and correctly identified 6 wells containing Cas9 inhibitors, all of these small molecule hits could be excluded as valuable lead compounds for cell or animal model-based testing.

Example 8: High-Throughput Assay Activity of Cas

Overall, we report the first high-throughput fluorescence assay for measuring Cas9 nuclease activity. The optimal substrate produced a large (~10-fold) signal change upon complete digestion, with the single nuclease domain "nickase" proteins producing a ~5-fold signal change. The near-identical results obtained with the Spy, Sau, and Cje Cas9 substrates lead us to believe that this assay procedure will be broadly applicable for any Cas9 variant, species' or engineered. Because the reported assay is far more scalable than previously published Cas9 assays,[3, 61-63] the characterization of Cas9 variants designed to have alternative PAM sequences or increased fidelity could be done with greater expedience and with a minimum amount of DNA and sgRNA. Additionally, given the ongoing research to identify naturally-occurring protein-based anti-CRISPRs,[57] the ability to simultaneously measure inhibition of many species of Cas9 on a single 384-well plate will facilitate the rapid classification of Cas9 inhibitors. This is particularly relevant as some anti-CRISPRs show activity against many Cas9 species.[59]

When this assay was used to screen for small molecule inhibitors of Cas9, a low hit-rate of 0.2% was obtained. The small number of hits reflects the difficulty of Cas9 as a drug target. The extensive binding contacts between the Cas9 protein and sgRNA or DNA produce an avidity that is difficult for a small molecule with a relatively few possible interactions to surmount. Additionally, there is a very limited opportunity for any reversible inhibitor to block Cas9 DNA cleavage, due to its single turnover kinetics. This is not unlike the challenge of developing small molecule inhibitors of protein-protein interactions, although there has been some success in this area.[64] Regardless, the assay showed excellent Z'-factors across the screen, and 6 wells containing Cas9 inhibitors were identified and confirmed from 189,606 starting compounds over the course of approximately 10 days. The low-volume format reduced the reagent consumption to ~60 nmol of DNA substrate, ~60 mg of Cas9, and ~26 mg of sgRNA for screening ~200,000 compounds. With a high signal-to-noise ratio, easy scalability, and low reagent consumption this assay is therefore useful for numerous applications throughout the broad CRISPR-Cas9 field.

Figure 22A:
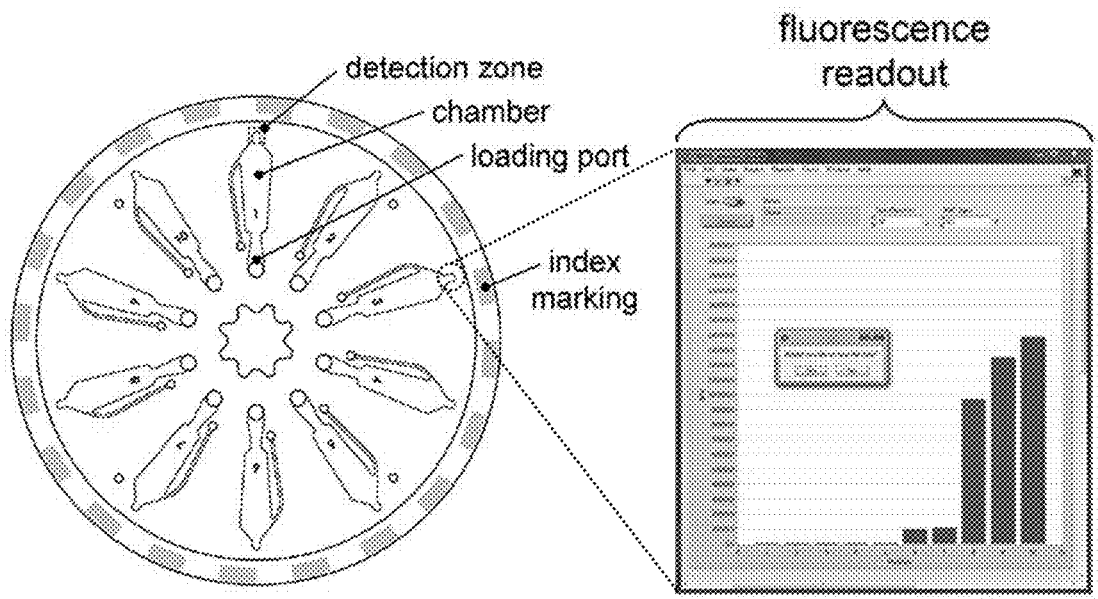
FIG. 22A-22B provides a non-limiting fluorescence-based assay for nuclease activity. Provided are (A) exemplary schematics of a chamber disc (left) for performing an assay in a centrifugal microfluidic platform and a screen capture (right) of a user interface featuring fluorescence measurements on such a platform; and (B) results for microparticle-immobilized fluorescence-based detection of S. pyogenes Cas9 nuclease activity in the presence of the substrate-specific AAVS1 guide RNA. Error bars represent standard deviation, points are average of four replicates, and the limits of detection are indicated in parentheses for each measurement.

Example 9: Ultrasensitive Detection of CRISPR-Cas9 by a Portable Centrifugal Microfluidic Platform Cas9 protein is one component required for genome modification; however, Cas9 nuclease activity and thus bound guide RNA is required to generate a double-stranded DNA break. To sensitively measure Cas9 activity in bodily fluids, we adapted a fluorescence Cas9 activity assay[65] for detection on a centrifugal microfluidic platform (FIG. 22A).

A fluorophore/quencher-labeled DNA duplex (containing the target sequence of interest) was immobilized on silica microparticles. Briefly, a Cy5 dye-labeled, biotinylated oligonucleotide was annealed with a shorter complementary quencher strand. The quenched duplex strand was then incubated with streptavidin-functionalized 5 mm silica microparticles for 2 h at room temperature and washed three times in Cas9 reaction buffer. The particles were concentrated to 20% w/v from the stock concentration of 1% by centrifugation.

Sample containing Cas9 and guide RNA was incubated with the substrate-functionalized particles, then separated by centrifugation through density medium that denatures the Cas9 protein to release bound DNA. Briefly, 10 mL of particles were incubated with 5 mL of sample for 25 m. The density medium for this experiment consisted of 2.5 M guanidinium hydrochloride to denature the Cas9 proteins bound to the DNA duplex, allowing the quencher strand to dissociate. 75 mL of density medium was added to the disc and spun for 5 s at 4000 rpm. The sample suspension was then added to the disc and spun for 1.5 m at 6000 rpm. Upon cleavage and denaturation, the quencher-conjugated DNA strand dissociates from the bead-immobilized fluorophore strand to generate an increase in fluorescence from the bead pellet that is proportional to Cas9 RNP concentration (FIG. 22B).

Figure 22B:
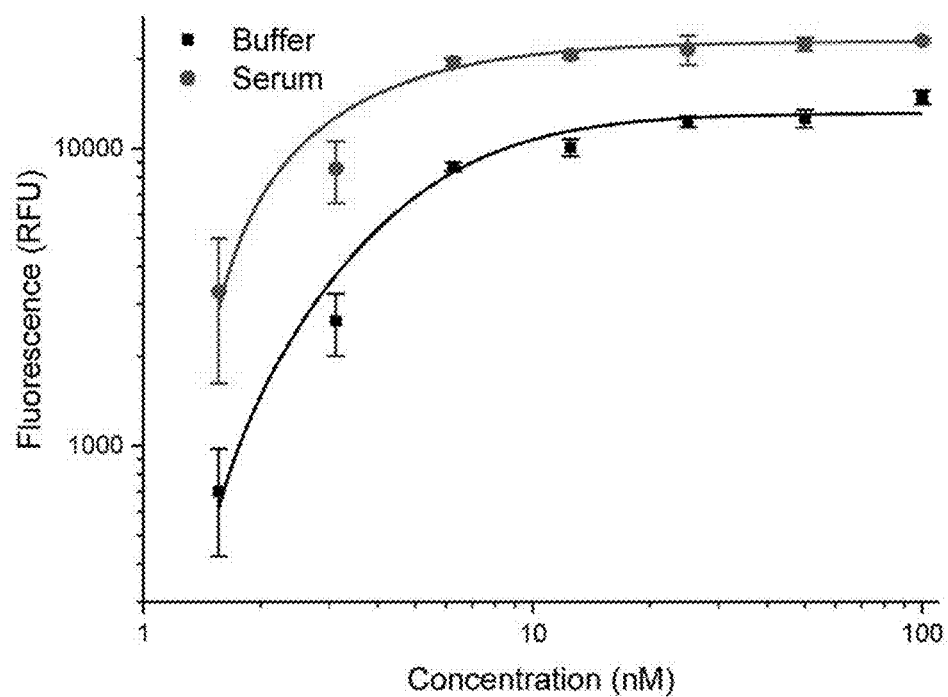

When Cas9 activity was measured directly in serum, only a marginal increase in background fluorescence was observed with the Cas9-dependent increase in fluorescence being almost identical to that in buffer (FIG. 22B). As this signal was dependent on Cas9 nuclease activity, and specifically endonuclease activity on a particular target sequence, it is the measurement most directly related to the genome modification potential. Further, we have previously shown that this activity measurement can be readily adapted to other species of Cas9 with different PAM sequences by modulating the DNA sequence and, in some cases, heating the sample.[65] We anticipate that this platform and the general protocols could be easily modified for the detection of protein and activity from nearly any species of Cas9.

To emphasize the importance of simultaneous Cas9 protein and target-specific nuclease activity in a single platform, we analyzed samples consisting of the wt Cas9 protein, the D10A and H840A nickase mutants with one active site disrupted, and the nuclease D10A/H840A dead Cas9. The chemiluminescence signal from all these Cas9 variants was identical, as expected, because the capture and detection antibodies are unlikely to contain an epitope overlapping these mutations (FIG. 23A).

Figure 23A:
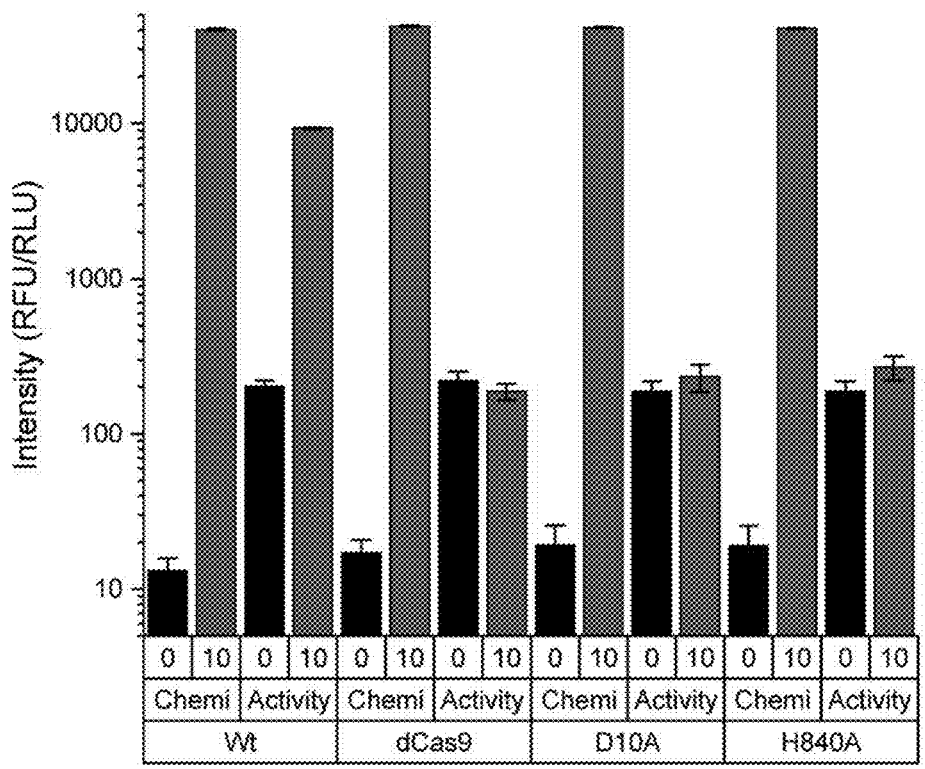
FIG. 23A-23B provides simultaneous Cas9 protein and nuclease activity detection. Provided are (A) a graph showing detection of chemiluminescent Cas9 protein and fluorescent nuclease activity for wild type (wt), the D10A and H840A nickase mutants with one active site disrupted, and the nuclease D10A/H840A dead Cas9 (dCas9) at 0 nM and 10 nM of Cas9; and (B) a graph showing detection of Cas9 protein and activity in human HEK293T cells transfected with on-target AAVS1 guide (AAVS1), off-target guide (scrambled), or an untransfected control. Error bars represent standard deviation, points are average of four replicates.

In contrast, the fluorescence-based Cas9 activity measurements in the presence of guide RNA showed almost no increase in fluorescence with the dCas9 or the nickase variants, but a significant increase in fluorescence with the wt Cas9 (FIG. 23A). These results confirm that our platform and the assay can, from a single sample, differentially identify Cas9 protein and activity.

To test this capability directly in cells, HEK293T human cells containing an integrated Cas9 reporter were transfected with plasmid encoding Cas9 protein and a scrambled (off-target) or on-target AAVS1 guide. The reporter produces red fluorescent protein (RFP) constitutively and, upon Cas9-mediated editing at the AAVS1 site, green fluorescent protein (GFP) is produced. Four days after transfection, the cells showed the expected presence of GFP in the on-target transfection, but no GFP in the off-target transfection or the untransfected control.

Figure 23B:
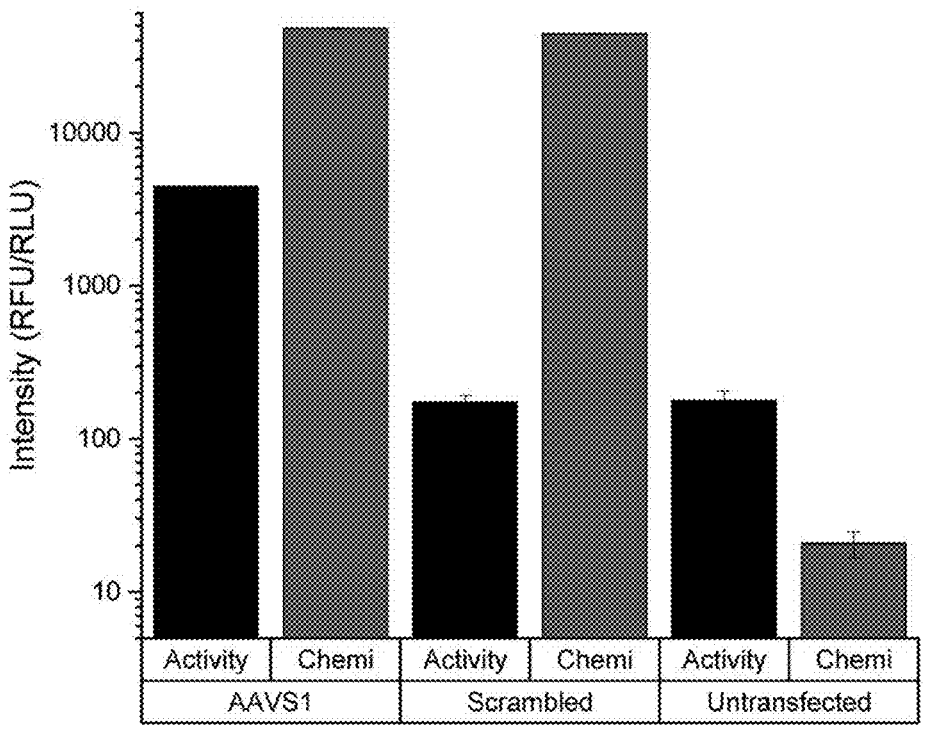

Just two days after transfection, the cells were lysed and analyzed for Cas9 protein and on-target nuclease activity. Even at this early time, the presence of Cas9 could be clearly identified as chemiluminescence signal in both the on- and off-target guide transfections, but not in the untransfected control (FIG. 23B). Further, from the same lysate Cas9 nuclease activity at the AAVS1 target site could be clearly observed via fluorescence in the on-target transfections, with no Cas9 activity in either the off-target or untransfected controls (FIG. 23B). The reported detection platform is therefore able to measure Cas9 protein and target-specific activity simultaneously, in cell lysates without any sample preparation, before any change in cellular phenotype can be observed.

REFERENCES (1) Jinek, M.; Chylinski, K.; Fonfara, I.; Hauer, M.; Doudna, J. A.; Charpentier, E. Science 2012, 337 (6096), 816-821.

(2) Hsu, P. D.; Scott, D. A.; Weinstein, J. A.; Ran, F. A.; Konermann, S.; Agarwala, V.; Li, Y.; Fine, E. J.; Wu, X.; Shalem, O.; Cradick, T. J.; Marraffini, L. A.; Bao, G.; Zhang, F. Nature Biotechnology 2013, 1-8.

(3) Pattanayak, V.; Lin, S.; Guilinger, J. P.; Ma, E.; Doudna, J. A.; Liu, D. R. Nature Biotechnology 2013, 1-7.

(4) Singh, D.; Sternberg, S. H.; Fei, J.; Doudna, J. A.; Ha, T. Nature Communications 2016, 7, 1-8.

(5) Chen, J. S.; Dagdas, Y. S.; Kleinstiver, B. P.; Welch, M. M.; Sousa, A. A.; Harrington, L. B.; Sternberg, S. H.; Joung, J. K.; Yildiz, A.; Doudna, J. A. Nature 2017, 550 (7676), 407-410.

(6) Sternberg, S. H.; LaFrance, B.; Kaplan, M.; Doudna, J. A. Nature 2015, 1-14.

(7) Mali, P.; Yang, L.; Esvelt, K. M.; Aach, J.; Guell, M.; DiCarlo, J. E.; Norville, J. E.; Church, G. M. Science 2013, 339 (6121), 823-826.

(8) Jinek, M.; East, A.; Cheng, A.; Lin, S.; Ma, E.; Doudna, J. eLife 2013, 2, 273-279.

(9) Cho, S. W.; Kim, S.; Kim, J. M.; Kim, J.-S. Nature Biotechnology 2013, 31 (3), 230-232.

(10) Wang, H.; Yang, H.; Shivalila, C. S.; Dawlaty, M. M.; Cheng, A. W.; Zhang, F.; Jaenisch, R. Cell 2013, 153 (4), 910-918.

(11) Gratz, S. J.; Cummings, A. M.; Nguyen, J. N.; Hamm, D. C.; Donohue, L. K.; Harrison, M. M.; Wildonger, J.; O'Connor-Giles, K. M. Genetics 2013, 194 (4), 1029-1035.

(12) Hwang, W. Y.; Fu, Y.; Reyon, D.; Maeder, M. L.; Tsai, S. Q.; Sander, J. D.; Peterson, R. T.; Yeh, J.-R. J.; Joung, J. K. Nature Biotechnology 2013, 1-3.

(13) Nakayama, T.; Fish, M. B.; Fisher, M.; Oomen-Hajagos, J.; Thomsen, G. H.; Grainger, R. M. genesis 2013, 51 (12), 835-843.

(14) Cong, L.; Ran, F. A.; Cox, D.; Lin, S.; Barretto, R.; Habib, N.; Hsu, P. D.; Wu, X.; Jiang, W.; Marraffini, L. A.; Zhang, F. Science 2013, 339 (6121), 819-823.

(15) Yao, X.; Wang, X.; Liu, J.; Hu, X.; Shi, L.; Shen, X.; Ying, W.; Sun, X.; Wang, X.; Huang, P.; Yang, H. EBioMedicine 2017, 20 (C), 19-26.

(16) Long, C.; McAnally, J. R.; Shelton, J. M.; Mireault, A. A.; Bassel-Duby, R.; Olson, E. N. Science 2014, 345 (6201), 1184-1188.

(17) Nelson, C. E.; Hakim, C. H.; Ousterout, D. G.; Thakore, P. I.; Moreb, E. A.; Rivera, R. M. C.; Madhavan, S.; Pan,

(18) Tabebordbar, M.; Zhu, K.; Cheng, J. K. W.; Chew, W. L.; Widrick, J. J.; Yan, W. X.; Maesner, C.; Wu, E. Y.; Xiao, R.; Ran, F. A.; Cong, L.; Zhang, F.; Vandenberghe, L. H.; Church, G. M.; Wagers, A. J. Science 2016, 351 (6271), 407-411.

(17) ...X.; Ran, F. A.; Yan, W. X.; Asokan, A.; Zhang, F.; Duan, D.; Gersbach, C. A. Science 2016, 351 (6271), 403-407.

(19) Wu, Y.; Liang, D.; Wang, Y.; Bai, M.; Tang, W.; Bao, S.; Yan, Z.; Li, D.; Li, J. Cell Stem Cell 2013, 13 (6), 659-662.

(20) Ding, Q.; Strong, A.; Patel, K. M.; Ng, S.-L.; Gosis, B. S.; Regan, S. N.; Cowan, C. A.; Rader, D. J.; Musunuru, K. Circ. Res. 2014, 115 (5), 488-492.

(21) Yang, Y.; Wang, L.; Bell, P.; McMenamin, D.; He, Z.; White, J.; Yu, H.; Xu, C.; Morizono, H.; Musunuru, K.; Batshaw, M. L.; Wilson, J. M. Nature Biotechnology 2016, 1-7.

(22) Cinesi, C.; Aeschbach, L. E. N.; Bin Yang; Dion, V. Nature Communications 2016, 7, 1-10.

(23) Pinto, B. S.; Saxena, T.; Oliveira, R.; Méndez-Gómez, H. R.; Cleary, J. D.; Denes, L. T.; McConnell, O.; Arboleda, J.; Xia, G.; Swanson, M. S.; Wang, E. T. Molecular Cell 2017, 1-18.

(24) Suzuki, K.; Tsunekawa, Y.; Hernandez-Benitez, R.; Wu, J.; Zhu, J.; Kim, E. J.; Hatanaka, F.; Yamamoto, M.; Araoka, T.; Li, Z.; Kurita, M.; Hishida, T.; Li, M.; Aizawa, E.; Guo, S.; Chen, S.; Goebl, A.; Soligalla, R. D.; Qu, J.; Jiang, T.; Fu, X.; Jafari, M.; Esteban, C. R.; Berggren, W. T.; Lajara, J.; Nunez-Delicado, E.; Guillen, P.; Campistol, J. M.; Matsuzaki, F.; Liu, G.-H.; Magistretti, P.; Zhang, K.; Callaway, E. M.; Zhang, K.; Belmonte, J. C. I. Nature 2016, 540 (7631), 144-149.

(25) Koo, T.; Yoon, A.-R.; Cho, H.-Y.; Bae, S.; Yun, C.-O.; Kim, J.-S. Nucleic Acids Research 2017, 45 (13), 7897-7908.

(26) Ohmori, T.; Nagao, Y.; Mizukami, H.; Sakata, A.; Muramatsu, S.-I.; Ozawa, K.; Tominaga, S.-I.; Hanazono, Y.; Nishimura, S.; Nureki, O.; Sakata, Y. Scientific Reports 2017, 7 (1), 362-11.

(27) Liu, C.; Zhang, L.; Liu, H.; Cheng, K. Journal of Controlled Release 2017, 1-34.

(28) Hu, J. H.; Miller, S. M.; Geurts, M. H.; Tang, W.; Chen, L.; Sun, N.; Zeina, C. M.; Gao, X.; Rees, H. A.; Lin, Z.; Liu, D. R. Nature 2018.

(29) Ran, F. A.; Cong, L.; Yan, W. X.; Scott, D. A.; Gootenberg, J. S.; Kriz, A. J.; Zetsche, B.; Shalem, O.; Wu, X.; Makarova, K. S.; Koonin, E. V.; Sharp, P. A.; Zhang, F. Nature 2015, 520 (7546), 186-191.

(30) Kim, E.; Koo, T.; Park, S. W.; Kim, D.; Kim, K.; Cho, H.-Y.; Song, D. W.; Lee, K. J.; Jung, M. H.; Kim, S.; Kim, J. H.; Kim, J. H.; Kim, J.-S. Nature Communications 2017, 8, 1-12.

(31) Fu, Y.; Reyon, D.; Cascio, V. M.; Sander, J. D.; Joung, J. K. Nature Biotechnology 2014, 1-8.

(32) Sullender, M.; Hegde, M.; Vaimberg, E. W.; Donovan, K. F.; Smith, I.; Tothova, Z.; Wilen, C.; Orchard, R.; Virgin, H. W.; Doench, J. G.; Fusi, N.; Listgarten, J.; Root, D. E. Nature Biotechnology 2016, 1-12.

(33) Zhang, J.-P.; Li, X.-L.; Neises, A.; Chen, W.; Hu, L.-P.; Ji, G.-Z.; Yu, J.-Y.; Xu, J.; Yuan, W.-P.; Cheng, T.; Zhang, X.-B. Scientific Reports 2016, 1-10.

(34) Slaymaker, I. M.; Gao, L.; Zetsche, B.; Scott, D. A.; Yan, W. X.; Zhang, F. Science 2015, 351 (6268), 84-88.

(35) Kleinstiver, B. P.; Pattanayak, V.; Prew, M. S.; Tsai, S. Q.; Nguyen, N. T.; Zheng, Z.; Joung, J. K. Nature 2016, 529 (7587), 490-495.

(36) Kulcsár, P. I.; Tálas, A.; Huszár, K.; Ligeti, Z.; Tóth, E.; Weinhardt, N.; Fodor, E.; Welker, E. 2017, 1-17.

(37) Senturk, S.; Shirole, N. H.; Nowak, D. G.; Corbo, V.; Pal, D.; Vaughan, A.; Tuveson, D. A.; Trotman, L. C.; Kinney, J. B.; Sordella, R. Nature Communications 2017, 8, 14370.

(38) Tu, Z.; Yang, W.; Yan, Sen; Yin, A.; Gao, J.; Liu, X.; Zheng, Y.; Zheng, J.; Li, Z.; Yang, S.; Li, S.; Guo, X.; Li, X.-J. Scientific Reports 2017, 1-11.

(39) Oakes, B. L.; Nadler, D. C.; Flamholz, A.; Fellmann, C.; Staahl, B. T.; Doudna, J. A.; Savage, D. F. Nature Biotechnology 2016, 34 (6), 646-651.

(40) Liu, K. I.; Bin Ramli, M. N.; Woo, C. W. A.; Wang, Y.; Zhao, T.; Zhang, X.; Yim, G. R. D.; Chong, B. Y.; Gowher, A.; Chua, M. Z. H.; Jung, J.; Lee, J. H. J.; Tan, M. H. Nature Chemical Biology 2016, 1-10.

(41) Rose, J. C.; Stephany, J. J.; Valente, W. J.; Trevillian, B. M.; Dang, H. V.; Bielas, J. H.; Maly, D. J.; Fowler, D. M. Nature Methods 2017, 1-11.

(42) Shin, J.; Jiang, F.; Liu, J.-J.; Bray, N. L.; Rauch, B. J.; Baik, S. H.; Nogales, E.; Bondy-Denomy, J.; Corn, J. E.; Doudna, J. A. Sci Adv 2017, 3 (7), e1701620.

(43) Mekler, V.; Minakhin, L.; Semenova, E.; Kuznedelov, K.; Severinov, K. Nucleic Acids Research 2016, 44 (6), 2837-2845.

(44) Mekler, V.; Minakhin, L.; Severinov, K. Proc Natl Acad Sci USA 2017, 114 (21), 5443-5448.

(45) Zhang, K.; Deng, R.; Li, Y.; Zhang, L.; Li, J. Chemical Science 2016, 7 (8), 4951-4957.

(46) Huang, M.; Zhou, X.; Wang, H.; Xing, D. Anal. Chem. 2017, acs.analchem.7b04542.

(47) Liu, W.; Yu, H.; Zhou, X.; Xing, D. Anal. Chem. 2016, 88 (17), 8369-8374.

(48) Kleinstiver, B. P.; Prew, M. S.; Tsai, S. Q.; Topkar, V. V.; Nguyen, N. T.; Zheng, Z.; Gonzales, A. P. W.; Li, Z.; Peterson, R. T.; Yeh, J.-R. J.; Aryee, M. J.; Joung, J. K. Nature 2015, 523 (7561), 481-485.

(49) Prew, M. S.; Tsai, S. Q.; Nguyen, N. T.; Topkar, V. V.; Zheng, Z.; Kleinstiver, B. P.; Joung, J. K. Nature Biotechnology 2015, 1-7.

(50) Strutt, S. C.; Torrez, R. M.; Kaya, E.; Negrete, O. A.; Doudna, J. A. eLife 2018, 7, e32724.

(51) Zuris, J. A.; Thompson, D. B.; Shu, Y.; Guilinger, J. P.; Bessen, J. L.; Hu, J. H.; Maeder, M. L.; Joung, J. K.; Chen, Z.-Y.; Liu, D. R. Nature Biotechnology 2014, 1-10.

(52) Schneider, C. A.; Rasband, W. S.; Eliceiri, K. W. Nature Methods 2012, 9 (7), 671-675.

(53) Xia, H.; Gravelsina, S.; Öhrmalm, C.; Ottoson, J.; Blomberg, J. BioTechniques 2016, 60 (1), 28-34.

(54) Sternberg, S. H.; Redding, S.; Jinek, M.; Greene, E. C.; Doudna, J. A. Nature 2014, 1-17.

(55) Wu, Z.; Yang, H.; Colosi, P. Mol. Ther. 2010, 18 (1), 80-86.

(56) Dugar, G.; Leenay, R. T.; Eisenbart, S. K.; Bischler, T.; Aul, B. U.; Beisel, C. L.; Sharma, C. M. Molecular Cell 2018, 69 (5), 893-905.e897.

(57) Rauch, B. J.; Silvis, M. R.; Hultquist, J. F.; Waters, C. S.; McGregor, M. J.; Krogan, N. J.; Bondy-Denomy, J. Cell 2016, 1-20.

(58) Pawluk, A.; Amrani, N.; Zhang, Y.; Garcia, B.; Hidalgo-Reyes, Y.; Lee, J.; Edraki, A.; Shah, M.; Sontheimer, E. J.; Maxwell, K. L.; Davidson, A. R. Cell 2016, 1-20.

(59) Harrington, L. B.; Doxzen, K. W.; Ma, E.; Liu, J.-J.; Knott, G. J.; Edraki, A.; Garcia, B.; Amrani, N.; Chen, J. S.; Cofsky, J. C.; Kranzusch, P. J.; Sontheimer, E. J.; Davidson, A. R.; Maxwell, K. L.; Doudna, J. A. Cell 2017, 1-26.

(60) Zhang, J.; Chung, T.; Oldenburg, K. J Biomol Screen 1999, 4 (2), 67-73.
(61) Marshall, R.; Maxwell, C. S.; Collins, S. P.; Jacobsen, T.; Luo, M. L.; Begemann, M. B.; Gray, B. N.; January, E.; Singer, A.; He, Y.; Beisel, C. L.; Noireaux, V. Molecular Cell 2018, 69 (1), 146-157.e3.
(62) Karvelis, T.; Gasiunas, G.; Young, J.; Bigelyte, G.; Silanskas, A.; Cigan, M.; Siksnys, V. Genome Biol. 2015, 16 (1), 253.
(63) Leenay, R. T.; Beisel, C. L. J. Mol. Biol. 2017, 429 (2), 177-191.
(64) Scott, D. E.; Bayly, A. R.; Abell, C.; Skidmore, J. Nat Rev Drug Discov 2016, 15 (8), 533-550.
(65) Seamon K J; Light Y K; Saada E A; Schoeniger J S; Harmon B1, Anal Chem 2018, 90(11), 6913-6921.

Other Embodiments

All publications, patents, and patent applications mentioned in this specification are incorporated herein by reference to the same extent as if each independent publication or patent application was specifically and individually indicated to be incorporated by reference.

While the invention has been described in connection with specific embodiments thereof, it will be understood that it is capable of further modifications and this application is intended to cover any variations, uses, or adaptations of the invention following, in general, the principles of the invention and including such departures from the present disclosure that come within known or customary practice within the art to which the invention pertains and may be applied to the essential features hereinbefore set forth, and follows in the scope of the claims.

Other embodiments are within the claims.

SEQUENCE LISTING (1219 sequences)

SEQ ID NO: 1 - DNA, 63 bp, Artificial Sequence
  Synthetic construct
agcaagctgacgtttgtactccagcgtctcatctttatgcgtcagcagagatttctgctgtgc

SEQ ID NO: 2 - DNA, 58 bp, Artificial Sequence
  Synthetic construct
  misc_feature (45)..(45): n can be a label or a dT having a label
  misc_feature (58)..(58): n can be a label or a dT having a label
gcacagcagaaatctctgctgacgcataaagagagacgctggagnacaaacgtcagcn

SEQ ID NO: 3 - DNA, 50 bp, Artificial Sequence
  Synthetic construct
  misc_feature (1)..(1): n can be a label or a dT having a label
ntgtactccagcgtctcatctttatgcgtcagcagagatttctgctgtgc

SEQ ID NO: 4 - DNA, 48 bp, Artificial Sequence
  Synthetic construct
  misc_feature (48)..(48): n can be a label or a dT having a label
gcacagcagaaatctctgctgacgcataaagatgagacgctggagtan

SEQ ID NO: 5 - DNA, 51 bp, Artificial Sequence
  Synthetic construct
tccgtgttcacgcgtctcatctttatgcgtcagcagagatttctgctgtgc

SEQ ID NO: 6 - DNA, 49 bp, Artificial Sequence
  Synthetic construct
gcacagcagaaatctctgctgacgcataaagatgagacgcgtgaacacg

SEQ ID NO: 7 - DNA, 50 bp, Artificial Sequence
  Synthetic construct
gcaaacatgaggtcgcagagtagaaatacgcagtcgtctctaaagacgac

SEQ ID NO: 8 - DNA, 63 bp, Artificial Sequence
  Synthetic construct
tcacagcagaaatctctgctgacgcataaagatgagacgctggagtacaaacgtcagcttgct

SEQ ID NO: 9 - DNA, 125 bp, Artificial Sequence
  Synthetic construct
taatacgactcactatagacgcataaagatgagacgcgttttagagctagaaatagcaagttaaaataaggctagtccgttatcaacttgaaaaagtggcaccgagtcggtgcttttttgaattc

SEQ ID NO: 10 - DNA, 123 bp, Artificial Sequence
  Synthetic construct
taatacgactcactatagctgacgcataaagatgagacgcgttttagtactctggaaacagaatctactaaaacaaggcaaaatgccgtgtttatctcgtcaacttgttggcgagatgaattc

SEQ ID NO: 11 - DNA, 119 bp, Artificial Sequence
  Synthetic construct
taatacgactcactatagctgacgcataaagatgagacgcgttttagtccctgaaaagggactaaaataaagagtttgcgggactctgcggggttacaatcccctaaaaccgcgaattc

SEQ ID NO: 12 - DNA, 101 bp, Artificial Sequence
  Synthetic construct
gacgcataaagatgagacgcgttttaggctagaaatagcaagttaaaataaggctagtccgttatcaacttgaaaaagtggcaccgagtcggtgctttttt

SEQ ID NO: 13 - DNA, 39 bp, Artificial Sequence
  Synthetic construct
aauuucuacuguuguagaugacgcataaagatgagacgc

SEQ ID NO: 14-19 - skipped (6 entries)

SEQ ID NO: 20 - DNA, 22 bp, Artificial Sequence
  Synthetic construct
tgagcaagctgacgtttgtact

SEQ ID NO: 21 - DNA, 20 bp, Artificial Sequence
  Synthetic construct
agcaagctgacgtttgtact

SEQ ID NO: 22 - DNA, 16 bp, Artificial Sequence
  Synthetic construct
tgctgacgtttgtact

SEQ ID NO: 23 - DNA, 15 bp, Artificial Sequence
  Synthetic construct
gctgacgtttgtact

SEQ ID NO: 24 - DNA, 13 bp, Artificial Sequence
  Synthetic construct
tgacgtttgtact

SEQ ID NO: 25 - DNA, 12 bp, Artificial Sequence
  Synthetic construct
gacgtttgtact

SEQ ID NO: 26 - DNA, 9 bp, Artificial Sequence
  Synthetic construct
gtttgtact

SEQ ID NO: 27 - DNA, 6 bp, Artificial Sequence
  Synthetic construct
tgtact

SEQ ID NO: 28 - DNA, 4 bp, Artificial Sequence
  Synthetic construct
tact

SEQ ID NO: 29 - DNA, 4 bp, Artificial Sequence
  Synthetic construct
tccg

SEQ ID NO: 30 - DNA, 3 bp, Artificial Sequence
  Synthetic construct
tgt

SEQ ID NO: 31 - DNA, 3 bp, Artificial Sequence
  Synthetic construct
cca

SEQ ID NO: 32 - DNA, 6 bp, Artificial Sequence
  Synthetic construct
actcca

SEQ ID NO: 33 - DNA, 7 bp, Artificial Sequence
  Synthetic construct
tgttcac

SEQ ID NO: 34 - DNA, 20 bp, Artificial Sequence
  Synthetic construct
agcagagatttctgctgtgc

SEQ ID NO: 35 - DNA, 17 bp, Artificial Sequence
  Synthetic construct
agcagagatttctgctg

SEQ ID NO: 36 - DNA, 17 bp, Artificial Sequence
  Synthetic construct
agagatttctgctgtgc

SEQ ID NO: 37 - DNA, 14 bp, Artificial Sequence
  Synthetic construct
agagatttctgctg

SEQ ID NO: 38 - DNA, 20 bp, Artificial Sequence
  Synthetic construct
agcagagatttctgctgtga

SEQ ID NO: 39 - DNA, 20 bp, Artificial Sequence
  Synthetic construct
gcacagcagaaatctctgct

SEQ ID NO: 40 - DNA, 17 bp, Artificial Sequence
  Synthetic construct
gcacagcagaaatctct

SEQ ID NO: 41 - DNA, 17 bp, Artificial Sequence
  Synthetic construct
cagcagaaatctctgct

SEQ ID NO: 42 - DNA, 14 bp, Artificial Sequence
  Synthetic construct
cagcagaaatctct

SEQ ID NO: 43 - DNA, 20 bp, Artificial Sequence
  Synthetic construct
tcacagcagaaatctctgct

SEQ ID NO: 44 - DNA, 3 bp, Artificial Sequence
  Synthetic construct
tgg

SEQ ID NO: 45 - DNA, 6 bp, Artificial Sequence
  Synthetic construct
tggagt

SEQ ID NO: 46 - DNA, 7 bp, Artificial Sequence
  Synthetic construct
gtgaaca

SEQ ID NO: 47 - DNA, 20 bp, Artificial Sequence
  Synthetic construct
agtacaaacgtcagcttgct

SEQ ID NO: 48 - DNA, 15 bp, Artificial Sequence
  Synthetic construct
agtacaaacgtcagc

SEQ ID NO: 49 - DNA, 15 bp, Artificial Sequence
  Synthetic construct
  misc_feature (3)..(3): T can optionally be dT
agtacaaacgtcagc

SEQ ID NO: 50 - DNA, 13 bp, Artificial Sequence
  Synthetic construct
agtacaaacgtca

SEQ ID NO: 51 - DNA, 12 bp, Artificial Sequence
  Synthetic construct
agtacaaacgtc

SEQ ID NO: 52 - DNA, 9 bp, Artificial Sequence
  Synthetic construct
agtacaaac

SEQ ID NO: 53 - DNA, 6 bp, Artificial Sequence
  Synthetic construct
agtaca

SEQ ID NO: 54 - DNA, 4 bp, Artificial Sequence
  Synthetic construct
agta

SEQ ID NO: 55 - DNA, 3 bp, Artificial Sequence
  Synthetic construct
aca

SEQ ID NO: 56 - DNA, 1 bp, Artificial Sequence
  Synthetic construct
a

SEQ ID NO: 57 - DNA, 4 bp, Artificial Sequence
  Synthetic construct
cgga

SEQ ID NO: 58 - DNA, 2 bp, Artificial Sequence
  Synthetic construct
cg

SEQ ID NO: 59-99 - skipped (41 entries)

SEQ ID NO: 100 - protein, 1054 aa, Staphylococcus aureus
MGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 101 - protein, 1054 aa, Artificial Sequence
  Synthetic construct
MGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 102 - protein, 1368 aa, Streptococcus pyogenes [sequence omitted]

SEQ ID NO: 103 - protein, 1368 aa, Artificial Sequence
  Synthetic construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 104 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 105 - protein, 1629 aa, Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 106-109 - skipped (4 entries)

SEQ ID NO: 110 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 111 - protein, 984 aa, Campylobacter jejuni; identical to SEQ ID NO: 104

SEQ ID NO: 112 - protein, 1409 aa, Streptococcus thermophilus
MLFNKCIIISINLDFSNKEKCMTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 113 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 114 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 115 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 116 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 117 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 118 - protein, 1334 aa, Staphylococcus pseudintermedius ED99
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 119 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 120 - protein, 1377 aa, Streptococcus pasteurianus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKADEIKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYNEDLEELLGKIGDDYADLFTSAKNLYDAILLSGILTVDDNSTKAPLSASMIKRYAEHHEDLEKLKEFIKANKSELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDVHKLIAKSSDDHSEMGKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 121 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 122 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 123 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 124 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 125 - protein, 1087 aa, Geobacillus stearothermophilus
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKPGKTIRPLQSTRD

SEQ ID NO: 126 - protein, 1087 aa, Geobacillus sp. LC300
MRYKIGLDIGITSVGWAVINLDIPRIEDLGVRIFDRAENPQTGESLALPRRLARSARRRLRRRKHRLERIRRLIIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYIAIWASQRPVASKDDIEKKVGFCTFEPKEKRAPKATYTFQSFIAWEHINKLRLISPSGTRGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIRSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYTEVDHVIPYSRSLDDSYTNKVLVLTKENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKIIKTAGGEEIKIKDLFAYYKTIHSGTAGLELVSHDCSFSLSGVGSRTLKRFEKYQVDVLGNIYKVRGEKRVGLASSAHSKTGETIRPLQSTRD

SEQ ID NO: 127-149 - skipped (23 entries)

SEQ ID NO: 150 - DNA, 36 bp, Artificial Sequence
  Synthetic construct
guuuuagagcuaugcuguuuugaauggucccaaaac

SEQ ID NO: 151 - DNA, 36 bp, Artificial Sequence
  Synthetic construct
gttttagagctatgctgttttgaatggtcccaaaac

SEQ ID NO: 152 - DNA, 22 bp, Artificial Sequence
  Synthetic construct
guuuuagagcuaugcuguuuug

SEQ ID NO: 153 - DNA, 22 bp, Artificial Sequence
  Synthetic construct
gttttagagctatgctgttttg

SEQ ID NO: 154 - DNA, 16 bp, Artificial Sequence
  Synthetic construct
guuuuagagcuaugcu

SEQ ID NO: 155 - DNA, 16 bp, Artificial Sequence
  Synthetic construct
gttttagagctatgct

SEQ ID NO: 156 - DNA, 13 bp, Artificial Sequence
  Synthetic construct
guuuuagagcuag

SEQ ID NO: 157 - DNA, 13 bp, Artificial Sequence
  Synthetic construct
gttttagagctag

SEQ ID NO: 158 - DNA, 12 bp, Artificial Sequence
  Synthetic construct
guuuuagagcua

SEQ ID NO: 159 - DNA, 12 bp, Artificial Sequence
  Synthetic construct
gttttagagcta

SEQ ID NO: 160 - DNA, 6 bp, Artificial Sequence
  Synthetic construct
ggaaac

SEQ ID NO: 161 - DNA, 5 bp, Artificial Sequence
  Synthetic construct
ggaaa

SEQ ID NO: 162 - DNA, 4 bp, Artificial Sequence
  Synthetic construct
gaaa

SEQ ID NO: 163 - DNA, 4 bp, Artificial Sequence
  Synthetic construct
tgaa

SEQ ID NO: 164 - DNA, 4 bp, Artificial Sequence
  Synthetic construct
ugaa

SEQ ID NO: 165 - DNA, 3 bp, Artificial Sequence
  Synthetic construct
aaa

SEQ ID NO: 166 - DNA, 67 bp, Artificial Sequence
  Synthetic construct
atagcaagttaaaataaggctagtccgttatcaacttgaaaaagtggcaccgagtcggtgctttttt

SEQ ID NO: 167 - DNA, 66 bp, Artificial Sequence
  Synthetic construct
tagcaagttaaaataaggctagtccgttatcaacttgaaaaagtggcaccgagtcggtgctttttt

SEQ ID NO: 168 - DNA, 60 bp, Artificial Sequence
  Synthetic construct
tagcaagttaaaataaggctagtccgttatcaacttgaaaaagtggcaccgagtcggtgc

SEQ ID NO: 169 - DNA, 36 bp, Artificial Sequence
  Synthetic construct
uuguuggaaccauucaaaacagcauagcaaguuaaa

SEQ ID NO: 170 - DNA, 36 bp, Artificial Sequence
  Synthetic construct
ttgttggaaccattcaaaacagcatagcaagttaaa

SEQ ID NO: 171 - DNA, 88 bp, Artificial Sequence
  Synthetic construct
guuggaaccauucaaaacagcauagcaaguuaaaauaaggcuaguccguuaucaacuugaaaaaguggcaccgagucggugcuuuuuu

SEQ ID NO: 172 - DNA, 88 bp, Artificial Sequence
  Synthetic construct
gttggaaccattcaaaacagcatagcaagttaaaataaggctagtccgttatcaacttgaaaaagtggcaccgagtcggtgctttttt

SEQ ID NO: 173 - DNA, 71 bp, Artificial Sequence
  Synthetic construct
cagcatagcaagttaaaataaggctagtccgttatcaacttgaaaaagtggcaccgagtcggtgctttttt

SEQ ID NO: 174 - DNA, 70 bp, Artificial Sequence
  Synthetic construct
agcatagcaagttaaaataaggctagtccgttatcaacttgaaaaagtggcaccgagtcggtgctttttt

SEQ ID NO: 175 - DNA, 69 bp, Artificial Sequence
  Synthetic construct
gcatagcaagttaaaataaggctagtccgttatcaacttgaaaaagtggcaccgagtcggtgctttttt

SEQ ID NO: 176 - DNA, 26 bp, Artificial Sequence
  Synthetic construct
tagcaagttaaaataaggctagtccg

SEQ ID NO: 177 - DNA, 26 bp, Artificial Sequence
  Synthetic construct
uagcaaguuaaaauaaggcuaguccg

SEQ ID NO: 178 - DNA, 33 bp, Artificial Sequence
  Synthetic construct
ggaaccauucaaaacagcauagcaaguuaaaau

SEQ ID NO: 179 - DNA, 33 bp, Artificial Sequence
  Synthetic construct
ggaaccattcaaaacagcatagcaagttaaaat

SEQ ID NO: 180 - DNA, 24 bp, Artificial Sequence
  Synthetic construct
caaaacagcauagcaaguuaaaau

SEQ ID NO: 181 - DNA, 24 bp, Artificial Sequence
  Synthetic construct
caaaacagcatagcaagttaaaat

SEQ ID NO: 182 - DNA, 70 bp, Artificial Sequence
  Synthetic construct
caaaacagcauagcaaguuaaaauaaggcuaguccguuaucaacuugaaaaaguggcaccgagucggugc

SEQ ID NO: 183 - DNA, 70 bp, Artificial Sequence
  Synthetic construct
caaaacagcatagcaagttaaaataaggctagtccgttatcaacttgaaaaagtggcaccgagtcggtgc

SEQ ID NO: 184 - DNA, 36 bp, Artificial Sequence
  Synthetic construct
gttttagtactctgtaattttaggtatgaggtagac

SEQ ID NO: 185 - DNA, 36 bp, Artificial Sequence
  Synthetic construct
guuuuaguacucuguaauuuuagguaugagguagac

SEQ ID NO: 186 - DNA, 14 bp, Artificial Sequence
  Synthetic construct
gttttagtactctg

SEQ ID NO: 187 - DNA, 14 bp, Artificial Sequence
  Synthetic construct
guuuuaguacucug

SEQ ID NO: 188 - DNA, 13 bp, Artificial Sequence
  Synthetic construct
gttttagtactct

SEQ ID NO: 189 - DNA, 13 bp, Artificial Sequence
  Synthetic construct
guuuuaguacucu

SEQ ID NO: 190 - DNA, 6 bp, Artificial Sequence
  Synthetic construct
ggaaac

SEQ ID NO: 191 - DNA, 5 bp, Artificial Sequence
  Synthetic construct
ggaaa

SEQ ID NO: 192 - DNA, 4 bp, Artificial Sequence
  Synthetic construct
gaaa

SEQ ID NO: 193 - DNA, 4 bp, Artificial Sequence
  Synthetic construct
tgaa

SEQ ID NO: 194 - DNA, 4 bp, Artificial Sequence
  Synthetic construct
ugaa

SEQ ID NO: 195 - DNA, 3 bp, Artificial Sequence
  Synthetic construct
aaa

SEQ ID NO: 196 - DNA, 85 bp, Artificial Sequence
  Synthetic construct
attgtacttatacctaaaattacagaatctactaaaacaaggcaaaatgccgtgtttatctcgtcaacttgttggcgagattttt

SEQ ID NO: 197 - DNA, 85 bp, Artificial Sequence
  Synthetic construct
auuguacuuauaccuaaaauuacagaaucuacuaaaacaaggcaaaaugccguguuuaucucgucaacuuguuggcgagauuuuu

SEQ ID NO: 198 - DNA, 64 bp, Artificial Sequence
  Synthetic construct
acagaatctactaaaacaaggcaaaatgccgtgtttatctcgtcaacttgttggcgagattttt

SEQ ID NO: 199 - DNA, 64 bp, Artificial Sequence
  Synthetic construct
acagaaucuacuaaaacaaggcaaaaugccguguuuaucucgucaacuuguuggcgagauuuuu

SEQ ID NO: 200 - DNA, 64 bp, Artificial Sequence; identical to SEQ ID NO: 198
  Synthetic construct

SEQ ID NO: 201 - DNA, 63 bp, Artificial Sequence
  Synthetic construct
acagaatctactaaaacaaggcaaaatgccgtgtttatctcgtcaacttgttggcgagatttt

SEQ ID NO: 202 - DNA, 62 bp, Artificial Sequence
  Synthetic construct
acagaatctactaaaacaaggcaaaatgccgtgtttatctcgtcaacttgttggcgagattt

SEQ ID NO: 203 - DNA, 61 bp, Artificial Sequence
  Synthetic construct
acagaatctactaaaacaaggcaaaatgccgtgtttatctcgtcaacttgttggcgagatt

SEQ ID NO: 204 - DNA, 60 bp, Artificial Sequence
  Synthetic construct
acagaatctactaaaacaaggcaaaatgccgtgtttatctcgtcaacttgttggcgagat

SEQ ID NO: 205 - DNA, 63 bp, Artificial Sequence
  Synthetic construct
cagaatctactaaaacaaggcaaaatgccgtgtttatctcgtcaacttgttggcgagattttt

SEQ ID NO: 206 - DNA, 63 bp, Artificial Sequence
  Synthetic construct
cagaaucuacuaaaacaaggcaaaaugccguguuuaucucgucaacuuguuggcgagauuuuu

SEQ ID NO: 207 - DNA, 62 bp, Artificial Sequence
  Synthetic construct
cagaatctactaaaacaaggcaaaatgccgtgtttatctcgtcaacttgttggcgagatttt

SEQ ID NO: 208 - DNA, 61 bp, Artificial Sequence
  Synthetic construct
cagaatctactaaaacaaggcaaaatgccgtgtttatctcgtcaacttgttggcgagattt

SEQ ID NO: 209 - DNA, 60 bp, Artificial Sequence
  Synthetic construct
cagaatctactaaaacaaggcaaaatgccgtgtttatctcgtcaacttgttggcgagatt

SEQ ID NO: 210 - DNA, 59 bp, Artificial Sequence
  Synthetic construct
cagaatctactaaaacaaggcaaaatgccgtgtttatctcgtcaacttgttggcgagat

SEQ ID NO: 211 - DNA, 30 bp, Artificial Sequence
  Synthetic construct
cagaatctactaaaacaaggcaaaatgccg

SEQ ID NO: 212 - DNA, 29 bp, Artificial Sequence
  Synthetic construct
cagaatctactaaaacaaggcaaaatgcc

SEQ ID NO: 213 - DNA, 35 bp, Artificial Sequence
  Synthetic construct
guuuuagucccuuuuuaaauuucuuuaugguaaau

SEQ ID NO: 214 - DNA, 35 bp, Artificial Sequence
  Synthetic construct
gttttagtccctttttaaatttctttatggtaaat

SEQ ID NO: 215 - DNA, 13 bp, Artificial Sequence
  Synthetic construct
gttttagtccctt

SEQ ID NO: 216 - DNA, 13 bp, Artificial Sequence
  Synthetic construct
guuuuagucccuu

SEQ ID NO: 217 - DNA, 12 bp, Artificial Sequence
  Synthetic construct
gttttagtccct

SEQ ID NO: 218 - DNA, 12 bp, Artificial Sequence
  Synthetic construct
guuuuagucccu

SEQ ID NO: 219 - DNA, 11 bp, Artificial Sequence
  Synthetic construct
gttttagtccc

SEQ ID NO: 220 - DNA, 11 bp, Artificial Sequence
  Synthetic construct
guuuuaguccc

SEQ ID NO: 221 - DNA, 4 bp, Artificial Sequence
  Synthetic construct
gaaa

SEQ ID NO: 222 - DNA, 4 bp, Artificial Sequence
  Synthetic construct
tgaa

SEQ ID NO: 223 - DNA, 4 bp, Artificial Sequence
  Synthetic construct
ugaa

SEQ ID NO: 224 - DNA, 5 bp, Artificial Sequence
  Synthetic construct
tgaaa

SEQ ID NO: 225 - DNA, 6 bp, Artificial Sequence
  Synthetic construct
tgaaaa

SEQ ID NO: 226 - DNA, 8 bp, Artificial Sequence
  Synthetic construct
atattcaa

SEQ ID NO: 227 - DNA, 12 bp, Artificial Sequence
  Synthetic construct
tgtggaaatata

SEQ ID NO: 228 - DNA, 74 bp, Artificial Sequence
  Synthetic construct
aagaaatttaaaaagggactaaaataaagagtttgcgggactctgcggggttacaatcccctaaaaccgctttt

SEQ ID NO: 229 - DNA, 74 bp, Artificial Sequence
  Synthetic construct
aagaaauuuaaaaagggacuaaaauaaagaguuugcgggacucugcgggguuacaauccccuaaaaccgcuuuu

SEQ ID NO: 230 - DNA, 64 bp, Artificial Sequence
  Synthetic construct
agggactaaaataaagagtttgcgggactctgcggggttacaatcccctaaaaccgcttttttt

SEQ ID NO: 231 - DNA, 64 bp, Artificial Sequence
  Synthetic construct
agggacuaaaauaaagaguuugcgggacucugcgggguuacaauccccuaaaaccgcuuuuuuu

SEQ ID NO: 232 - DNA, 63 bp, Artificial Sequence
  Synthetic construct
agggactaaaataaagagtttgcgggactctgcggggttacaatcccctaaaaccgctttttt

SEQ ID NO: 233 - DNA, 62 bp, Artificial Sequence
  Synthetic construct
agggactaaaataaagagtttgcgggactctgcggggttacaatcccctaaaaccgcttttt

SEQ ID NO: 234 - DNA, 61 bp, Artificial Sequence
  Synthetic construct
agggactaaaataaagagtttgcgggactctgcggggttacaatcccctaaaaccgctttt

SEQ ID NO: 235 - DNA, 60 bp, Artificial Sequence
  Synthetic construct
agggactaaaataaagagtttgcgggactctgcggggttacaatcccctaaaaccgcttt

SEQ ID NO: 236 - DNA, 59 bp, Artificial Sequence
  Synthetic construct
agggactaaaataaagagtttgcgggactctgcggggttacaatcccctaaaaccgctt

SEQ ID NO: 237 - DNA, 58 bp, Artificial Sequence
  Synthetic construct
agggactaaaataaagagtttgcgggactctgcggggttacaatcccctaaaaccgct

SEQ ID NO: 238 - DNA, 57 bp, Artificial Sequence
  Synthetic construct
agggactaaaataaagagtttgcgggactctgcggggttacaatcccctaaaaccgc

SEQ ID NO: 239 - DNA, 63 bp, Artificial Sequence
  Synthetic construct
gggactaaaataaagagtttgcgggactctgcggggttacaatcccctaaaaccgcttttttt

SEQ ID NO: 240 - DNA, 63 bp, Artificial Sequence
  Synthetic construct
gggacuaaaauaaagaguuugcgggacucugcgggguuacaauccccuaaaaccgcuuuuuuu

SEQ ID NO: 241 - DNA, 62 bp, Artificial Sequence
  Synthetic construct
gggactaaaataaagagtttgcgggactctgcggggttacaatcccctaaaaccgctttttt

SEQ ID NO: 242 - DNA, 61 bp, Artificial Sequence
  Synthetic construct
gggactaaaataaagagtttgcgggactctgcggggttacaatcccctaaaaccgcttttt

SEQ ID NO: 243 - DNA, 60 bp, Artificial Sequence
  Synthetic construct
gggactaaaataaagagtttgcgggactctgcggggttacaatcccctaaaaccgctttt

SEQ ID NO: 244 - DNA, 59 bp, Artificial Sequence
  Synthetic construct
gggactaaaataaagagtttgcgggactctgcggggttacaatcccctaaaaccgcttt

SEQ ID NO: 245 - DNA, 58 bp, Artificial Sequence
  Synthetic construct
gggactaaaataaagagtttgcgggactctgcggggttacaatcccctaaaaccgctt

SEQ ID NO: 246 - DNA, 57 bp, Artificial Sequence
  Synthetic construct
gggactaaaataaagagtttgcgggactctgcggggttacaatcccctaaaaccgct

SEQ ID NO: 247 - DNA, 56 bp, Artificial Sequence
  Synthetic construct
gggactaaaataaagagtttgcgggactctgcggggttacaatcccctaaaaccgc

SEQ ID NO: 248 - DNA, 30 bp, Artificial Sequence
  Synthetic construct
gggactaaaataaagagtttgcgggactct

SEQ ID NO: 249 - DNA, 36 bp, Artificial Sequence
  Synthetic construct
gtttttgtactctcaagatttaagtaactgtacaac

SEQ ID NO: 250 - DNA, 36 bp, Artificial Sequence
  Synthetic construct
gttttagagctgtgttgtttcgaatggttccaaaac

SEQ ID NO: 251 - DNA, 36 bp, Artificial Sequence
  Synthetic construct
ggtttgaaaccattcgaaacaacacagcgagttaaa

SEQ ID NO: 252 - DNA, 36 bp, Artificial Sequence
  Synthetic construct
cttacacagttacttaaatcttgcagaagctacaaa

SEQ ID NO: 253 - DNA, 27 bp, Artificial Sequence
  Synthetic construct
gtttttgtactctcaagatttaagtaa

SEQ ID NO: 254 - DNA, 18 bp, Artificial Sequence
  Synthetic construct
gtttttgtactctcaaga

SEQ ID NO: 255 - DNA, 17 bp, Artificial Sequence
  Synthetic construct
gtttttgtactctcaag

SEQ ID NO: 256 - DNA, 27 bp, Artificial Sequence
  Synthetic construct
gttttagagctgtgttgtttcgaatgg

SEQ ID NO: 257 - DNA, 23 bp, Artificial Sequence
  Synthetic construct
gttttagagctgtgttgtttcga

SEQ ID NO: 258 - DNA, 17 bp, Artificial Sequence
  Synthetic construct
gttttagagctgtgttg

SEQ ID NO: 259 - DNA, 17 bp, Artificial Sequence
  Synthetic construct
ggtttgaaaccattcga

SEQ ID NO: 260 - DNA, 16 bp, Artificial Sequence
  Synthetic construct
ggtttgaaaccattcg

SEQ ID NO: 261 - DNA, 27 bp, Artificial Sequence
  Synthetic construct
guuauuguacucucaagauuuauuuuu

SEQ ID NO: 262 - DNA, 27 bp, Artificial Sequence
  Synthetic construct
gttattgtactctcaagatttattttt

SEQ ID NO: 263 - DNA, 17 bp, Artificial Sequence
  Synthetic construct
cttacacagttacttaa

SEQ ID NO: 264 - DNA, 15 bp, Artificial Sequence
  Synthetic construct
cttacacagttactt

SEQ ID NO: 265 - DNA, 4 bp, Artificial Sequence
  Synthetic construct
gaaa

SEQ ID NO: 266 - DNA, 4 bp, Artificial Sequence
  Synthetic construct
taaa

SEQ ID NO: 267 - DNA, 4 bp, Artificial Sequence
  Synthetic construct
attt

SEQ ID NO: 268 - DNA, 4 bp, Artificial Sequence
  Synthetic construct
gttt

SEQ ID NO: 269 - DNA, 3 bp, Artificial Sequence
  Synthetic construct
ttt

SEQ ID NO: 270 - DNA, 3 bp, Artificial Sequence
  Synthetic construct
aaa

SEQ ID NO: 271 - DNA, 90 bp, Artificial Sequence
  Synthetic construct
ttacttaaatcttgcagaagctacaaagataaggcttcatgccgaaatcaacaccctgtcattttatggcagggtgttttcgttatttaa

SEQ ID NO: 272 - DNA, 104 bp, Artificial Sequence
  Synthetic construct
gtaaggggcgccttacacagttacttaaatcttgcagaagctacaaagataaggcttcatgccgaaatcaacaccctgtcattttatggcagggtgttttcgtt

SEQ ID NO: 273 - DNA, 93 bp, Artificial Sequence
  Synthetic construct
cttacacagttacttaaatcttgcagaagctacaaagataaggcttcatgccgaaatcaacaccctgtcattttatggcagggtgttttcgtt

SEQ ID NO: 274 - DNA, 90 bp, Artificial Sequence
  Synthetic construct
cttacacagttacttaaatcttgcagaagctacaaagataaggcttcatgccgaaatcaacaccctgtcattttatggcagggtgttttt

SEQ ID NO: 275 - DNA, 85 bp, Artificial Sequence
  Synthetic construct
cttacacagttacttaaatcttgcagaagctacaaagataaggcttcatgccgaaatcaacaccctgtcattttatggcagggtg

SEQ ID NO: 276 - DNA, 36 bp, Artificial Sequence; identical to SEQ ID NO: 252
  Synthetic construct

SEQ ID NO: 277 - DNA, 96 bp, Artificial Sequence
  Synthetic construct
ttgtggtttgaaaccattcgaaacaacacagcgagttaaaataaggcttagtccgtactcaacttgaaaaggtggcaccgattcggtgtttttttt

SEQ ID NO: 278 - DNA, 92 bp, Artificial Sequence
  Synthetic construct
ggtttgaaaccattcgaaacaacacagcgagttaaaataaggcttagtccgtactcaacttgaaaaggtggcaccgattcggtgtttttttt

SEQ ID NO: 279 - DNA, 36 bp, Artificial Sequence; identical to SEQ ID NO: 251
  Synthetic construct

SEQ ID NO: 280 - DNA, 91 bp, Artificial Sequence
  Synthetic construct
guuacuuaaaucuugcagaagcuacaaagauaaggcuucaugccgaaaucaacacccugucauuuuauggcaggguguuuucguuauuuaa

SEQ ID NO: 281 - DNA, 91 bp, Artificial Sequence
  Synthetic construct
gttacttaaatcttgcagaagctacaaagataaggcttcatgccgaaatcaacaccctgtcattttatggcagggtgttttcgttatttaa

SEQ ID NO: 282 - DNA, 15 bp, Artificial Sequence
  Synthetic construct
uguuucaguugcgcc

SEQ ID NO: 283 - DNA, 15 bp, Artificial Sequence
  Synthetic construct
tgtttcagttgcgcc

SEQ ID NO: 284 - DNA, 45 bp, Artificial Sequence
  Synthetic construct
guuucaguugcugaauuauuugguaaacaguaccaaauaauuaau

SEQ ID NO: 285 - DNA, 45 bp, Artificial Sequence
  Synthetic construct
gtttcagttgcugaattatttggtaaacagtaccaaataattaat

SEQ ID NO: 286 - DNA, 14 bp, Artificial Sequence
  Synthetic construct
gtttcagttgcgcc

SEQ ID NO: 287 - DNA, 14 bp, Artificial Sequence
  Synthetic construct
guuucaguugcgcc

SEQ ID NO: 288 - DNA, 6 bp, Artificial Sequence
  Synthetic construct
ggaaac

SEQ ID NO: 289 - DNA, 5 bp, Artificial Sequence
  Synthetic construct
ggaaa

SEQ ID NO: 290 - DNA, 4 bp, Artificial Sequence
  Synthetic construct
gaaa

SEQ ID NO: 291 - DNA, 5 bp, Artificial Sequence
  Synthetic construct
gaaag

SEQ ID NO: 292 - DNA, 4 bp, Artificial Sequence
  Synthetic construct
tgaa

SEQ ID NO: 293 - DNA, 4 bp, Artificial Sequence
  Synthetic construct
ugaa

SEQ ID NO: 294 - DNA, 3 bp, Artificial Sequence
  Synthetic construct
aaa

SEQ ID NO: 295 - DNA, 55 bp, Artificial Sequence
  Synthetic construct
ggcgcucuguaaucauuuaaaaguauuuugaacggaccucuguuugacacgucug

SEQ ID NO: 296 - DNA, 55 bp, Artificial Sequence
  Synthetic construct
ggcgctctgtaatcatttaaaagtattttgaacggacctctgtttgacacgtctg

SEQ ID NO: 297 - DNA, 71 bp, Artificial Sequence
  Synthetic construct
gcucuguaaucauuuaaaaguauuuugaacggaccucuguuugacacgucugaauaacuaaaaauuuuuuu

SEQ ID NO: 298 - DNA, 72 bp, Artificial Sequence
  Synthetic construct
ggcucuguaaucauuuaaaaguauuuugaacggaccucuguuugacacgucugaauaacuaaaaauuuuuuu

SEQ ID NO: 299 - DNA, 74 bp, Artificial Sequence
  Synthetic construct
ggcgcucuguaaucauuuaaaaguauuuugaacggaccucuguuugacacgucugaauaacuaaaaauuuuuuu

SEQ ID NO: 300 - DNA, 71 bp, Artificial Sequence
  Synthetic construct
gctctgtaatcatttaaaagtattttgaacggacctctgtttgacacgtctgaataactaaaaattttttt

SEQ ID NO: 301 - DNA, 72 bp, Artificial Sequence
  Synthetic construct
ggctctgtaatcatttaaaagtattttgaacggacctctgtttgacacgtctgaataactaaaaattttttt

SEQ ID NO: 302 - DNA, 74 bp, Artificial Sequence
  Synthetic construct
ggcgctctgtaatcatttaaaagtattttgaacggacctctgtttgacacgtctgaataactaaaaattttttt

SEQ ID NO: 303 - DNA, 65 bp, Artificial Sequence
  Synthetic construct
gctctgtaatcatttaaaagtattttgaacggacctctgtttgacacgtctgaataactaaaaat

SEQ ID NO: 304 - DNA, 66 bp, Artificial Sequence
  Synthetic construct
ggctctgtaatcatttaaaagtattttgaacggacctctgtttgacacgtctgaataactaaaaat

SEQ ID NO: 305 - DNA, 68 bp, Artificial Sequence
  Synthetic construct
ggcgctctgtaatcatttaaaagtattttgaacggacctctgtttgacacgtctgaataactaaaaat

SEQ ID NO: 306 - DNA, 12 bp, Artificial Sequence
  Synthetic construct
ggcgcucuguaa

SEQ ID NO: 307 - DNA, 12 bp, Artificial Sequence
  Synthetic construct
ggcgctctgtaa

SEQ ID NO: 308 - DNA, 24 bp, Artificial Sequence
  Synthetic construct
gttgtagctccctttctcatttcg

SEQ ID NO: 309 - DNA, 24 bp, Artificial Sequence
  Synthetic construct
guuguagcucccuuucucauuucg

SEQ ID NO: 310 - DNA, 30 bp, Artificial Sequence
  Synthetic construct
guuguagcucccuuucucauuucgcagugc

SEQ ID NO: 311 - DNA, 18 bp, Artificial Sequence
  Synthetic construct
guuguagcucccuuucuc

SEQ ID NO: 312 - DNA, 6 bp, Artificial Sequence
  Synthetic construct
ggaaac

SEQ ID NO: 313 - DNA, 5 bp, Artificial Sequence
  Synthetic construct
ggaaa

SEQ ID NO: 314 - DNA, 4 bp, Artificial Sequence
  Synthetic construct
gaaa

SEQ ID NO: 315 - DNA, 4 bp, Artificial Sequence
  Synthetic construct
tgaa

SEQ ID NO: 316 - DNA, 4 bp, Artificial Sequence
  Synthetic construct
ugaa

SEQ ID NO: 317 - DNA, 3 bp, Artificial Sequence
  Synthetic construct
aaa

SEQ ID NO: 318 - DNA, 93 bp, Artificial Sequence
  Synthetic construct
cgaaaugagaaccguugcuacaauaaggccgucugaaaagaugugccgcaacgcucugccccuuaaagcuucugcuuuaaggggcaucguuua

SEQ ID NO: 319 - DNA, 93 bp, Artificial Sequence
  Synthetic construct
cgaaatgagaaccgttgctacaataaggccgtctgaaaagatgtgccgcaacgctctgccccttaaagcttctgctttaaggggcatcgttta

SEQ ID NO: 320 - DNA, 107 bp, Artificial Sequence
  Synthetic construct
auauugucgcacugcgaaaugagaaccguugcuacaauaaggccgucugaaaagaugugccgcaacgcucugccccuuaaagcuucugcuuuaaggggcaucguuua

SEQ ID NO: 321 - DNA, 108 bp, Artificial Sequence
  Synthetic construct
attattgtcgcactgcgaaatgagaaccgttgctacaataaggccgtctgaaaagatgtgccgcaacgctctgccccttaaagcttctgctttaaggggcatcgttta

SEQ ID NO: 322 - DNA, 91 bp, Artificial Sequence
  Synthetic construct
aaaugagaaccguugcuacaauaaggccgucugaaaagaugugccgcaacgcucugccccuuaaagcuucugcuuuaaggggcaucguuua

SEQ ID NO: 323 - DNA, 91 bp, Artificial Sequence
  Synthetic construct
aaatgagaaccgttgctacaataaggccgtctgaaaagatgtgccgcaacgctctgccccttaaagcttctgctttaaggggcatcgttta

SEQ ID NO: 324 - DNA, 48 bp, Artificial Sequence
  Synthetic construct
cgaaaugagaaccguugcuacaauaaggccgucugaaaagaugugccg

SEQ ID NO: 325 - DNA, 48 bp, Artificial Sequence
  Synthetic construct
cgaaatgagaaccgttgctacaataaggccgtctgaaaagatgtgccg

SEQ ID NO: 326 - DNA, 31 bp, Artificial Sequence
  Synthetic construct
cgaaaugagaaccguugcuacaauaaggccg

SEQ ID NO: 327 - DNA, 31 bp, Artificial Sequence
  Synthetic construct
cgaaatgagaaccgttgctacaataaggccg

SEQ ID NO: 328 - DNA, 81 bp, Artificial Sequence
  Synthetic construct
gcacugcgaaaugagaaccguugcuacaauaaggccgucugaaaagaugugccgcaacgcucugccccuuaaagcuucugc

SEQ ID NO: 329 - DNA, 79 bp, Artificial Sequence
  Synthetic construct
gagaaccgttgctacaataaggccgtctgaaaagatgtgccgcaacgctctgccccttaaagcttctgctttaaggggc

SEQ ID NO: 330 - DNA, 84 bp, Artificial Sequence
  Synthetic construct
gagaaccgttgctacaataaggccgtctgaaaagatgtgccgcaacgctctgccccttaaagcttctgctttaaggggcttttt

SEQ ID NO: 331 - DNA, 16 bp, Artificial Sequence
  Synthetic construct
gucauaguuccccuga

SEQ ID NO: 332 - DNA, 16 bp, Artificial Sequence
  Synthetic construct
gtcatagttcccctga

SEQ ID NO: 333 - DNA, 25 bp, Artificial Sequence
  Synthetic construct
gucauaguuccccugagauuaucgc

SEQ ID NO: 334 - DNA, 25 bp, Artificial Sequence
  Synthetic construct
gtcatagttcccctgagattatcgc

SEQ ID NO: 335 - DNA, 36 bp, Artificial Sequence
  Synthetic construct
gucauaguuccccugagauuaucgcugugguauaau

SEQ ID NO: 336 - DNA, 36 bp, Artificial Sequence
  Synthetic construct
gtcatagttcccctgagattatcgctgtggtataat

SEQ ID NO: 337 - DNA, 4 bp, Artificial Sequence
  Synthetic construct
gaaa

SEQ ID NO: 338 - DNA, 4 bp, Artificial Sequence
  Synthetic construct
tgaa

SEQ ID NO: 339 - DNA, 4 bp, Artificial Sequence
  Synthetic construct
ugaa

SEQ ID NO: 340 - DNA, 4 bp, Artificial Sequence
  Synthetic construct
aaaa

SEQ ID NO: 341 - DNA, 3 bp, Artificial Sequence
  Synthetic construct
aaa

SEQ ID NO: 342 - DNA, 91 bp, Artificial Sequence
  Synthetic construct
ucaggguuacuaugauaagggcuuucugccuaaggcagacugacccgcggcguuggggaucgccugucgcccgcuuuuggcgggcauuccc

SEQ ID NO: 343 - DNA, 91 bp, Artificial Sequence
  Synthetic construct
tcagggttactatgataagggctttctgcctaaggcagactgacccgcggcgttggggatcgcctgtcgcccgcttttggcgggcattccc

SEQ ID NO: 344 - DNA, 98 bp, Artificial Sequence
  Synthetic construct
ucaggguuacuaugauaagggcuuucugccuaaggcagacugacccgcggcguuggggaucgccugucgcccgcuuuuggcgggcauuccccauccuu

SEQ ID NO: 345 - DNA, 98 bp, Artificial Sequence
  Synthetic construct
tcagggttactatgataagggctttctgcctaaggcagactgacccgcggcgttggggatcgcctgtcgcccgcttttggcgggcattccccatcctt

SEQ ID NO: 346 - DNA, 115 bp, Artificial Sequence
  Synthetic construct
auaccacagcaaugaucucaggguuacuaugauaagggcuuucugccuaaggcagacugacccgcggcguuggggaucgccugucgcccgcuuuuggcgggcauuccccauccuu

SEQ ID NO: 347 - DNA, 115 bp, Artificial Sequence
  Synthetic construct
ataccacagcaatgatctcagggttactatgataagggctttctgcctaaggcagactgacccgcggcgttggggatcgcctgtcgcccgcttttggcgggcattccccatcctt

SEQ ID NO: 348 - DNA, 104 bp, Artificial Sequence
  Synthetic construct
augaucucaggguuacuaugauaagggcuuucugccuaaggcagacugacccgcggcguuggggaucgccugucgcccgcuuuuggcgggcauuccccauccuu

SEQ ID NO: 349 - DNA, 104 bp, Artificial Sequence
  Synthetic construct
atgatctcagggttactatgataagggctttctgcctaaggcagactgacccgcggcgttggggatcgcctgtcgcccgcttttggcgggcattccccatcctt

SEQ ID NO: 350 - DNA, 84 bp, Artificial Sequence
  Synthetic construct
  misc_feature (1)..(1): n can be any third portion (D) described herein
  misc_feature (2)..(2): n can be any targeting portion (V) described herein
nnguuuuagagcuagaaauagcaaguuaaaauaaggcuaguccguuaucaacuugaaaaaguggcaccgagucggugcuuuuuu

SEQ ID NO: 351 - DNA, 84 bp, Artificial Sequence
  Synthetic construct
  misc_feature (1)..(1): n can be any third portion (D) described herein
  misc_feature (2)..(2): n can be any targeting portion (V) described herein
nngttttagagctagaaatagcaagttaaaataaggctagtccgttatcaacttgaaaaagtggcaccgagtcggtgctttttt

SEQ ID NO: 352 - DNA, 80 bp, Artificial Sequence
  Synthetic construct
  misc_feature (1)..(1): n can be any third portion (D) described herein
  misc_feature (2)..(2): n can be any targeting portion (V) described herein
nnguuuuagagcuagaaauagcaaguuaaaauaaggcuaguccguuaucaacuugaaaaaguggcaccgagucggugcuu

SEQ ID NO: 353 - DNA, 80 bp, Artificial Sequence
  Synthetic construct
  misc_feature (1)..(1): n can be any third portion (D) described herein
  misc_feature (2)..(2): n can be any targeting portion (V) described herein
nngttttagagctagaaatagcaagttaaaataaggctagtccgttatcaacttgaaaaagtggcaccgagtcggtgctt

SEQ ID NO: 354 - DNA, 44 bp, Artificial Sequence
  Synthetic construct
  misc_feature (1)..(1): n can be any third portion (D) described herein
  misc_feature (2)..(2): n can be any targeting portion (V) described herein
nnguuuuagagcuagaaauagcaaguuaaaauaaggcuaguccg

SEQ ID NO: 355 - DNA, 44 bp, Artificial Sequence
  Synthetic construct
  misc_feature (1)..(1): n can be any third portion (D) described herein
  misc_feature (2)..(2): n can be any targeting portion (V) described herein
nngttttagagctagaaatagcaagttaaaataaggctagtccg

SEQ ID NO: 356 - DNA, 36 bp, Artificial Sequence
  Synthetic construct
  misc_feature (1)..(1): n can be any third portion (D) described herein
  misc_feature (2)..(2): n can be any targeting portion (V) described herein
nnguuuuagagcuagaaauagcaaguuaaaauaagg

SEQ ID NO: 357 - DNA, 36 bp, Artificial Sequence
  Synthetic construct
  misc_feature (1)..(1): n can be any third portion (D) described herein
  misc_feature (2)..(2): n can be any targeting portion (V) described herein
nngttttagagctagaaatagcaagttaaaataagg

SEQ ID NO: 358 - DNA, 83 bp, Artificial Sequence
  Synthetic construct
  misc_feature (1)..(1): n can be any third portion (D) described herein
  misc_feature (2)..(2): n can be any targeting portion (V) described herein
nnguuuuaguacucuggaaacagaaucuacuaaaacaaggcaaaaugccguguuuaucucgucaacuuguuggcgagauuuuu

SEQ ID NO: 359 - DNA, 83 bp, Artificial Sequence
  Synthetic construct
  misc_feature (1)..(1): n can be any third portion (D) described herein
  misc_feature (2)..(2): n can be any targeting portion (V) described herein
nngttttagtactctggaaacagaatctactaaaacaaggcaaaatgccgtgtttatctcgtcaacttgttggcgagattttt

SEQ ID NO: 360 - DNA, 81 bp, Artificial Sequence
  Synthetic construct
  misc_feature (1)..(1): n can be any third portion (D) described herein
  misc_feature (2)..(2): n can be any targeting portion (V) described herein
nnguuuuaguacucuggaaacagaaucuacuaaaacaaggcaaaaugccguguuuaucucgucaacuuguuggcgagauuu

SEQ ID NO: 361 - DNA, 81 bp, Artificial Sequence
  Synthetic construct
  misc_feature (1)..(1): n can be any third portion (D) described herein
  misc_feature (2)..(2): n can be any targeting portion (V) described herein
nngttttagtactctggaaacagaatctactaaaacaaggcaaaatgccgtgtttatctcgtcaacttgttggcgagattt

SEQ ID NO: 362 - DNA, 75 bp, Artificial Sequence
  Synthetic construct
  misc_feature (1)..(1): n can be any third portion (D) described herein
  misc_feature (2)..(2): n can be any targeting portion (V) described herein
nngttttagtccctgaaaagggactaaaataaagagtttgcgggactctgcggggttacaatcccctaaaaccgc

SEQ ID NO: 363 - DNA, 75 bp, Artificial Sequence; identical to SEQ ID NO: 362
  Synthetic construct
  misc_feature (1)..(1): n can be any third portion (D) described herein
  misc_feature (2)..(2): n can be any targeting portion (V) described herein

SEQ ID NO: 364 - DNA, 75 bp, Artificial Sequence
  Synthetic construct
  misc_feature (1)..(1): n can be any third portion (D) described herein
  misc_feature (2)..(2): n can be any targeting portion (V) described herein
nnguuuuagucccugaaaagggacuaaaauaaagaguuugcgggacucugcgggguuacaauccccuaaaaccgc

SEQ ID NO: 365 - DNA, 81 bp, Artificial Sequence
  Synthetic construct
  misc_feature (1)..(1): n can be any third portion (D) described herein
  misc_feature (2)..(2): n can be any targeting portion (V) described herein
nngttttagtccctgaaaagggactaaaataaagagtttgcgggactctgcggggttacaatcccctaaaaccgctttttt

SEQ ID NO: 366 - DNA, 82 bp, Artificial Sequence
  Synthetic construct
  misc_feature (1)..(1): n can be any third portion (D) described herein
  misc_feature (2)..(2): n can be any targeting portion (V) described herein
nngttttagtccctgaaaagggactaaaataaagagtttgcgggactctgcggggttacaatcccctaaaaccgcttttttt

SEQ ID NO: 367 - DNA, 80 bp, Artificial Sequence
  Synthetic construct
  misc_feature (1)..(1): n can be any third portion (D) described herein
  misc_feature (2)..(2): n can be any targeting portion (V) described herein
nngttttagtccctgaagggactaaaataaaagagtttgcgggactctgcggggttacaatcccctaaaaccgctttttt

SEQ ID NO: 368 - DNA, 90 bp, Artificial Sequence
  Synthetic construct
  misc_feature (1)..(1): n can be any third portion (D) described herein
  misc_feature (2)..(2): n can be any targeting portion (V) described herein
nngttttagtcccttgtggaaatataagggactaaaataaagagtttgcgggactctgcggggttacaatcccctaaaaccgcttttttt

SEQ ID NO: 369 - DNA, 86 bp, Artificial Sequence
  Synthetic construct
  misc_feature (1)..(1): n can be any third portion (D) described herein
  misc_feature (2)..(2): n can be any targeting portion (V) described herein
nngttttagtccctatattcaaagggactaaaataaagagtttgcgggactctgcggggttacaatcccctaaaaccgcttttttt

SEQ ID NO: 370 - DNA, 102 bp, Artificial Sequence
  Synthetic construct
  misc_feature (1)..(1): n can be any third portion (D) described herein
  misc_feature (2)..(2): n can be any targeting portion (V) described herein
nngtttttgtactctcaagataaatgcagaagctacaaagataaggcttcatgccgaaatcaacaccctgtcattttatggcagggtgttttcgttatttaa

SEQ ID NO: 371 - DNA, 102 bp, Artificial Sequence
  Synthetic construct
  misc_feature (1)..(1): n can be any third portion (D) described herein
  misc_feature (2)..(2): n can be any targeting portion (V) described herein
nngtttttgtactctcaagattaatgcagaagctacaaagataaggcttcatgccgaaatcaacaccctgtcattttatggcagggtgttttcgttatttaa

SEQ ID NO: 372 - DNA, 92 bp, Artificial Sequence
  Synthetic construct
  misc_feature (1)..(1): n can be any third portion (D) described herein
  misc_feature (2)..(2): n can be any targeting portion (V) described herein
nngtttttgtactctcaagataaatgcagaagctacaaagataaggcttcatgccgaaatcaacaccctgtcattttatggcagggtgtttt

SEQ ID NO: 373 - DNA, 92 bp, Artificial Sequence
  Synthetic construct
  misc_feature (1)..(1): n can be any third portion (D) described herein
  misc_feature (2)..(2): n can be any targeting portion (V) described herein
nngtttttgtactctcaagattaatgcagaagctacaaagataaggcttcatgccgaaatcaacaccctgtcattttatggcagggtgtttt

SEQ ID NO: 374 - DNA, 99 bp, Artificial Sequence
  Synthetic construct
  misc_feature (1)..(1): n can be any third portion (D) described herein
  misc_feature (2)..(2): n can be any targeting portion (V) described herein
nngttttagagctgtgttgtttgttaaaacaacacagcgagttaaaataaggcttagtccgtactcaacttgaaaaggtggcaccgattcggtgttttt

SEQ ID NO: 375 - DNA, 75 bp, Artificial Sequence
  Synthetic construct
  misc_feature (1)..(1): n can be any third portion (D) described herein
  misc_feature (2)..(2): n can be any targeting portion (V) described herein
nnguuucaguugcgccgaaaggcgcucuguaaucauuuaaaaguauuuugaacggaccucuguuugacacgucug

SEQ ID NO: 376 - DNA, 32 bp, Artificial Sequence
  Synthetic construct
  misc_feature (1)..(1): n can be any third portion (D) described herein
  misc_feature (2)..(2): n can be any targeting portion (V) described herein
nnguuucaguugcgccgaaaggcgcucuguaa

SEQ ID NO: 377 - DNA, 32 bp, Artificial Sequence
  Synthetic construct
  misc_feature (1)..(1): n can be any third portion (D) described herein
  misc_feature (2)..(2): n can be any targeting portion (V) described herein
nngtttcagttgcgccgaaaggcgctctgtaa

SEQ ID NO: 378 - DNA, 108 bp, Artificial Sequence
  Synthetic construct
  misc_feature (1)..(1): n can be any third portion (D) described herein
  misc_feature (2)..(2): n can be any targeting portion (V) described herein
nnguuguagcucccuuucucgaaagagaaccgttgctacaataaggccgtctgaaaagatgtgccgcaacgctctgccccttaaagcttctgctttaaggggcttttt

SEQ ID NO: 379 - DNA, 103 bp, Artificial Sequence
  Synthetic construct
  misc_feature (1)..(1): n can be any third portion (D) described herein
  misc_feature (2)..(2): n can be any targeting portion (V) described herein
nnguuguagcucccuuucucgaaagagaaccgttgctacaataaggccgtctgaaaagatgtgccgcaacgctctgccccttaaagcttctgctttaaggggc

SEQ ID NO: 380 - DNA, 113 bp, Artificial Sequence
  Synthetic construct
  misc_feature (1)..(1): n can be any third portion (D) described herein
  misc_feature (2)..(2): n can be any targeting portion (V) described herein
nngucauaguuccccugagaaaucaggguuacuaugauaagggcuuucugccuaaggcagacugacccgcggcguuggggaucgccugucgcccgcuuuuggcgggcauuccc

SEQ ID NO: 381 - DNA, 113 bp, Artificial Sequence
  Synthetic construct
  misc_feature (1)..(1): n can be any third portion (D) described herein
  misc_feature (2)..(2): n can be any targeting portion (V) described herein
nngtcatagttcccctgagaaatcagggttactatgataagggctttctgcctaaggcagactgacccgcggcgttggggatcgcctgtcgcccgcttttggcgggcattccc

SEQ ID NO: 382 - DNA, 120 bp, Artificial Sequence
  Synthetic construct
  misc_feature (1)..(1): n can be any third portion (D) described herein
  misc_feature (2)..(2): n can be any targeting portion (V) described herein
nngucauaguuccccugagaaaucaggguuacuaugauaagggcuuucugccuaaggcagacugacccgcggcguuggggaucgccugucgcccgcuuuuggcgggcauuccccauccuu

SEQ ID NO: 383 - DNA, 120 bp, Artificial Sequence
  Synthetic construct
  misc_feature (1)..(1): n can be any third portion (D) described herein
  misc_feature (2)..(2): n can be any targeting portion (V) described herein
nngtcatagttcccctgagaaatcagggttactatgataagggctttctgcctaaggcagactgacccgcggcgttggggatcgcctgtcgcccgcttttggcgggcattccccatcctt

SEQ ID NO: 384 - DNA, 157 bp, Artificial Sequence
  Synthetic construct
  misc_feature (1)..(1): n can be any third portion (D) described herein
  misc_feature (2)..(2): n can be any targeting portion (V) described herein
nngucauaguuccccugagauuaucgcugugguauaaugaaaauaccacagcaaugaucucaggguuacuaugauaagggcuuucugccuaaggcagacugacccgcggcguuggggaucgccugucgcccgcuuuuggcgggcauuccccauccuu

SEQ ID NO: 385 - DNA, 157 bp, Artificial Sequence
  Synthetic construct
  misc_feature (1)..(1): n can be any third portion (D) described herein
  misc_feature (2)..(2): n can be any targeting portion (V) described herein
nngtcatagttcccctgagattatcgctgtggtataatgaaaataccacagcaatgatctcagggttactatgataagggctttctgcctaaggcagactgacccgcggcgttggggatcgcctgtcgcccgcttttggcgggcattccccatcctt

SEQ ID NO: 386 - DNA, 135 bp, Artificial Sequence
  Synthetic construct
  misc_feature (1)..(1): n can be any third portion (D) described herein
  misc_feature (2)..(2): n can be any targeting portion (V) described herein
nngucauaguuccccugagauuaucgcgaaaaugaucucaggguuacuaugauaagggcuuucugccuaaggcagacugacccgcggcguuggggaucgccugucgcccgcuuuuggcgggcauuccccauccuu

SEQ ID NO: 387 - DNA, 135 bp, Artificial Sequence
  Synthetic construct
  misc_feature (1)..(1): n can be any third portion (D) described herein
  misc_feature (2)..(2): n can be any targeting portion (V) described herein
nngtcatagttcccctgagattatcgcgaaaatgatctcagggttactatgataagggctttctgcctaaggcagactgacccgcggcgttggggatcgcctgtcgcccgcttttggcgggcattccccatcctt

SEQ ID NO: 388 - DNA, 30 bp, Artificial Sequence
  Synthetic construct
  misc_feature (10)..(10): n can be any target site (T) described herein
tgtactccanagcagagatttctgctgtgc

SEQ ID NO: 389 - DNA, 31 bp, Artificial Sequence
  Synthetic construct
  misc_feature (1)..(1): n can be any label (L) described herein
  misc_feature (11)..(11): n can be any target site (T) described herein
ntgtactccanagcagagatttctgctgtgc

SEQ ID NO: 390 - DNA, 44 bp, Artificial Sequence
  Synthetic construct
  misc_feature (24)..(24): n can be any target site (T) described herein
agcaagctgacgtttgtactccanagcagagatttctgctgtgc

SEQ ID NO: 391 - DNA, 45 bp, Artificial Sequence
  Synthetic construct
  misc_feature (1)..(1): n can be any label (L) described herein
  misc_feature (25)..(25): n can be any target site (T) described herein
nagcaagctgacgtttgtactccanagcagagatttctgctgtgc

SEQ ID NO: 392 - DNA, 30 bp, Artificial Sequence; identical to SEQ ID NO: 388
  Synthetic construct
  misc_feature (10)..(10): n can be any target site (T) described herein

SEQ ID NO: 393 - DNA, 31 bp, Artificial Sequence; identical to SEQ ID NO: 389
  Synthetic construct
  misc_feature (1)..(1): n can be any label (L) described herein
  misc_feature (11)..(11): n can be any target site (T) described herein

SEQ ID NO: 394 - DNA, 29 bp, Artificial Sequence
  Synthetic construct
  misc_feature (9)..(9): n can be any target site (T) described herein
tgtcactcnagcagagatttctgctgtgc

SEQ ID NO: 395 - DNA, 30 bp, Artificial Sequence
  Synthetic construct
  misc_feature (1)..(1): n can be any label (L) described herein
  misc_feature (10)..(10): n can be any target site (T) described herein
ntgtcactcnagcagagatttctgctgtgc

SEQ ID NO: 396 - DNA, 32 bp, Artificial Sequence
  Synthetic construct
  misc_feature (12)..(12): n can be any target site (T) described herein
tccgtgttcacnagcagagatttctgctgtgc

SEQ ID NO: 397 - DNA, 33 bp, Artificial Sequence
  Synthetic construct
  misc_feature (1)..(1): n can be any label (L) described herein
  misc_feature (13)..(13): n can be any target site (T) described herein
ntccgtgttcacnagcagagatttctgctgtgc

SEQ ID NO: 398 - DNA, 33 bp, Artificial Sequence
  Synthetic construct
  misc_feature (13)..(13): n can be any target site (T) described herein
tccggtgtccccnagcagagatttctgctgtgc

SEQ ID NO: 399 - DNA, 34 bp, Artificial Sequence
  Synthetic construct
  misc_feature (1)..(1): n can be any label (L) described herein
  misc_feature (14)..(14): n can be any target site (T) described herein
ntccggtgtccccnagcagagatttctgctgtgc

SEQ ID NO: 400 - DNA, 28 bp, Artificial Sequence
  Synthetic construct
  misc_feature (21)..(21): n can be any complementary target site (U) described herein
gcacagcagaaatctctgctntggagta

SEQ ID NO: 401 - DNA, 30 bp, Artificial Sequence
  Synthetic construct
  misc_feature (21)..(21): n can be any complementary target site (U) described herein
gcacagcagaaatctctgctntggagtaca

SEQ ID NO: 402 - DNA, 38 bp, Artificial Sequence
  Synthetic construct
  misc_feature (21)..(21): n can be any complementary target site (U) described herein
gcacagcagaaatctctgctntggagacaaacgtcagc

SEQ ID NO: 403 - DNA, 39 bp, Artificial Sequence
  Synthetic construct
  misc_feature (21)..(21): n can be any complementary target site (U) described herein
gcacagcagaaatctctgctntggagtacaaacgtcagc

SEQ ID NO: 404 - DNA, 29 bp, Artificial Sequence
  Synthetic construct
  misc_feature (21)..(21): n can be any complementary target site (U) described herein
  misc_feature (29)..(29): n can be any label (L) described herein
gcacagcagaaatctctgctntggagtan

SEQ ID NO: 405 - DNA, 31 bp, Artificial Sequence
  Synthetic construct
  misc_feature (21)..(21): n can be any complementary target site (U) described herein
  misc_feature (31)..(31): n can be any label (L) described herein
gcacagcagaaatctctgctntggagtacan

SEQ ID NO: 406 - DNA, 42 bp, Artificial Sequence
  Synthetic construct
  misc_feature (21)..(21): n can be any complementary target site (U) described herein
  misc_feature (22)..(22): n can be any label (L) described herein
  misc_feature (29)..(29): n can be any label (L) described herein
  misc_feature (42)..(42): n can be any label (L) described herein
gcacagcagaaatctctgctnntggagtnacaaacgtcagcn

SEQ ID NO: 407 - DNA, 41 bp, Artificial Sequence
  Synthetic construct
  misc_feature (21)..(21): n can be any complementary target site (U) described herein
  misc_feature (22)..(22): n can be any label (L) described herein
  misc_feature (28)..(28): n can be any label (L) described herein
  misc_feature (41)..(41): n can be any label (L) described herein
gcacagcagaaatctctgctnntggagnacaaacgtcagcn

SEQ ID NO: 408 - DNA, 25 bp, Artificial Sequence
  Synthetic construct
  misc_feature (18)..(18): n can be any complementary target site (U) described herein
gcacagcagaaatctctntggagta

SEQ ID NO: 409 - DNA, 28 bp, Artificial Sequence
  Synthetic construct
  misc_feature (21)..(21): n can be any complementary target site (U) described herein
tcacagcagaaatctctgctntggagta

SEQ ID NO: 410 - DNA, 27 bp, Artificial Sequence
  Synthetic construct
  misc_feature (18)..(18): n can be any complementary target site (U) described herein
gcacagcagaaatctctntggagtaca

SEQ ID NO: 411 - DNA, 26 bp, Artificial Sequence
  Synthetic construct
  misc_feature (18)..(18): n can be any complementary target site (U) described herein
  misc_feature (26)..(26): n can be any label (L) described herein
gcacagcagaaatctctntggagtan

SEQ ID NO: 412 - DNA, 29 bp, Artificial Sequence
  Synthetic construct
  misc_feature (21)..(21): n can be any complementary target site (U) described herein
  misc_feature (29)..(29): n can be any label (L) described herein
tcacagcagaaatctctgctntggagtan

SEQ ID NO: 413 - DNA, 28 bp, Artificial Sequence
  Synthetic construct
  misc_feature (18)..(18): n can be any complementary target site (U) described herein
  misc_feature (28)..(28): n can be any label (L) described herein
gcacagcagaaatctctntggagtacan

SEQ ID NO: 414 - DNA, 27 bp, Artificial Sequence
  Synthetic construct
  misc_feature (18)..(18): n can be any complementary target site (U) described herein
gcacagcagaaatctctngtgaacacg

SEQ ID NO: 415 - DNA, 29 bp, Artificial Sequence
  Synthetic construct
  misc_feature (18)..(18): n can be any complementary target site (U) described herein
gcacagcagaaatctctngtgaacacgga

SEQ ID NO: 416 - DNA, 28 bp, Artificial Sequence
  Synthetic construct
  misc_feature (18)..(18): n can be any complementary target site (U) described herein
  misc_feature (28)..(28): n can be any label (L) described herein
gcacagcagaaatctctngtgaacacgn

SEQ ID NO: 417 - DNA, 30 bp, Artificial Sequence
  Synthetic construct
  misc_feature (18)..(18): n can be any complementary target site (U) described herein
  misc_feature (30)..(30): n can be any label (L) described herein
gcacagcagaaatctctngtgaacacggan

SEQ ID NO: 418-419 - skipped (2 entries)

SEQ ID NO: 420 - protein, 1300 aa, Francisella novicida U112
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 421 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 422 - protein, 1228 aa, Lachnospiraceae bacterium ND2006
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGAAGYKSLFKKDIIETILPEAADDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNAKTKQALPKFKPLYKQVLSDRESLSFYGEGYTSDEEVLEVFRNTLNKNSEIFSSIKKLEKLFKNFDEYSSAGIFVKNGPAISTISKDIFGEWNLIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFAAAKKNNVFAWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 423-424 - skipped (2 entries)

SEQ ID NO: 425 - DNA, 9 bp, Artificial Sequence
  Synthetic construct
aauuucuac

SEQ ID NO: 426 - DNA, 9 bp, Artificial Sequence
  Synthetic construct
aatttctac

SEQ ID NO: 427 - DNA, 9 bp, Artificial Sequence
  Synthetic construct
aauuucugc

SEQ ID NO: 428 - DNA, 9 bp, Artificial Sequence
  Synthetic construct
aatttctgc

SEQ ID NO: 429 - DNA, 9 bp, Artificial Sequence
  Synthetic construct
aauuuccac

SEQ ID NO: 430 - DNA, 9 bp, Artificial Sequence
  Synthetic construct
aatttccac

SEQ ID NO: 431 - DNA, 9 bp, Artificial Sequence
  Synthetic construct
aauuccuac

SEQ ID NO: 432 - DNA, 9 bp, Artificial Sequence
  Synthetic construct
aattcctac

SEQ ID NO: 433 - DNA, 9 bp, Artificial Sequence
  Synthetic construct
uaauuucua

SEQ ID NO: 434 - DNA, 9 bp, Artificial Sequence
  Synthetic construct
taatttcta

SEQ ID NO: 435 - DNA, 4 bp, Artificial Sequence
  Synthetic construct
uguu

SEQ ID NO: 436 - DNA, 4 bp, Artificial Sequence
  Synthetic construct
tgtt

SEQ ID NO: 437 - DNA, 4 bp, Artificial Sequence
  Synthetic construct
ucuu

SEQ ID NO: 438 - DNA, 4 bp, Artificial Sequence
  Synthetic construct
tctt

SEQ ID NO: 439 - DNA, 4 bp, Artificial Sequence
  Synthetic construct
uauu

SEQ ID NO: 440 - DNA, 4 bp, Artificial Sequence
  Synthetic construct
tatt

SEQ ID NO: 441 - DNA, 4 bp, Artificial Sequence
  Synthetic construct
ugcu

SEQ ID NO: 442 - DNA, 4 bp, Artificial Sequence
  Synthetic construct
tgct

SEQ ID NO: 443 - DNA, 3 bp, Artificial Sequence
  Synthetic construct
uuu

SEQ ID NO: 444 - DNA, 3 bp, Artificial Sequence
  Synthetic construct
ttt

SEQ ID NO: 445 - DNA, 6 bp, Artificial Sequence
  Synthetic construct
guagau

SEQ ID NO: 446 - DNA, 6 bp, Artificial Sequence
  Synthetic construct
gtagat

SEQ ID NO: 447 - DNA, 6 bp, Artificial Sequence
  Synthetic construct
gcagau

SEQ ID NO: 448 - DNA, 6 bp, Artificial Sequence
  Synthetic construct
gcagat

SEQ ID NO: 449 - DNA, 6 bp, Artificial Sequence
  Synthetic construct
guggau

SEQ ID NO: 450 - DNA, 6 bp, Artificial Sequence
  Synthetic construct
gtggat

SEQ ID NO: 451 - DNA, 6 bp, Artificial Sequence
  Synthetic construct
guaggu

SEQ ID NO: 452 - DNA, 6 bp, Artificial Sequence
  Synthetic construct
gtaggt

SEQ ID NO: 453 - DNA, 19 bp, Artificial Sequence
  Synthetic construct
aauuucuacuguuguagau

SEQ ID NO: 454 - DNA, 19 bp, Artificial Sequence
  Synthetic construct
aatttctactgttgtagat

SEQ ID NO: 455 - DNA, 19 bp, Artificial Sequence
  Synthetic construct
aauuucugcuguugcagau

SEQ ID NO: 456 - DNA, 19 bp, Artificial Sequence
  Synthetic construct
aatttctgctgttgcagat

SEQ ID NO: 457 - DNA, 19 bp, Artificial Sequence
  Synthetic construct
aauuuccacuguuguggau

SEQ ID NO: 458 - DNA, 19 bp, Artificial Sequence
  Synthetic construct
aatttccactgttgtggat

SEQ ID NO: 459 - DNA, 19 bp, Artificial Sequence
  Synthetic construct
aauuccuacuguuguaggu

SEQ ID NO: 460 - DNA, 19 bp, Artificial Sequence
  Synthetic construct
aattcctactgttgtaggt

SEQ ID NO: 461 - DNA, 20 bp, Artificial Sequence
  Synthetic construct
uaauuucuacuguuguagau

SEQ ID NO: 462 - DNA, 20 bp, Artificial Sequence
  Synthetic construct
taatttctactgttgtagat

SEQ ID NO: 463 - DNA, 9 bp, Artificial Sequence
  Synthetic construct
aauuucuac

SEQ ID NO: 464 - DNA, 9 bp, Artificial Sequence
  Synthetic construct
aatttctac

SEQ ID NO: 465 - DNA, 10 bp, Artificial Sequence
  Synthetic construct
uaauuucuac

SEQ ID NO: 466 - DNA, 10 bp, Artificial Sequence
  Synthetic construct
taatttctac

SEQ ID NO: 467 - DNA, 9 bp, Artificial Sequence
  Synthetic construct
aauuucugc

SEQ ID NO: 468 - DNA, 9 bp, Artificial Sequence
  Synthetic construct
aatttctgc

SEQ ID NO: 469 - DNA, 9 bp, Artificial Sequence
  Synthetic construct
aauuuccac

SEQ ID NO: 470 - DNA, 9 bp, Artificial Sequence
  Synthetic construct
aatttccac

SEQ ID NO: 471 - DNA, 9 bp, Artificial Sequence
  Synthetic construct
aauuccuac

SEQ ID NO: 472 - DNA, 9 bp, Artificial Sequence
  Synthetic construct
aattcctac

SEQ ID NO: 473 - DNA, 9 bp, Artificial Sequence
  Synthetic construct
uaauuucua

SEQ ID NO: 474 - DNA, 9 bp, Artificial Sequence
  Synthetic construct
taatttcta

SEQ ID NO: 475 - DNA, 4 bp, Artificial Sequence
  Synthetic construct
uguu

SEQ ID NO: 476 - DNA, 4 bp, Artificial Sequence
  Synthetic construct
tgtt

SEQ ID NO: 477 - DNA, 4 bp, Artificial Sequence
  Synthetic construct
ucuu

SEQ ID NO: 478 - DNA, 4 bp, Artificial Sequence
  Synthetic construct
tctt

SEQ ID NO: 479 - DNA, 4 bp, Artificial Sequence
  Synthetic construct
uauu

SEQ ID NO: 480 - DNA, 4 bp, Artificial Sequence
  Synthetic construct
tatt

SEQ ID NO: 481 - DNA, 4 bp, Artificial Sequence
  Synthetic construct
ugcu

SEQ ID NO: 482 - DNA, 4 bp, Artificial Sequence
  Synthetic construct
tgct

SEQ ID NO: 483 - DNA, 3 bp, Artificial Sequence
  Synthetic construct
uuu

SEQ ID NO: 484 - DNA, 3 bp, Artificial Sequence
  Synthetic construct
ttt

SEQ ID NO: 485 - DNA, 6 bp, Artificial Sequence
  Synthetic construct
guagau

SEQ ID NO: 486 - DNA, 6 bp, Artificial Sequence
  Synthetic construct
gtagat

SEQ ID NO: 487 - DNA, 6 bp, Artificial Sequence
  Synthetic construct
gcagau

SEQ ID NO: 488 - DNA, 6 bp, Artificial Sequence
  Synthetic construct
gcagat

SEQ ID NO: 489 - DNA, 6 bp, Artificial Sequence
  Synthetic construct
guggau

SEQ ID NO: 490 - DNA, 6 bp, Artificial Sequence
  Synthetic construct
gtggat

SEQ ID NO: 491 - DNA, 6 bp, Artificial Sequence
  Synthetic construct
guaggu

SEQ ID NO: 492 - DNA, 6 bp, Artificial Sequence
  Synthetic construct
gtaggt

SEQ ID NO: 493 - DNA, 19 bp, Artificial Sequence
  Synthetic construct
aauuucuacucuuguagau

SEQ ID NO: 494 - DNA, 19 bp, Artificial Sequence
  Synthetic construct
aatttctactcttgtagat

SEQ ID NO: 495 - DNA, 20 bp, Artificial Sequence
  Synthetic construct
uaauuucuacucuuguagau

SEQ ID NO: 496 - DNA, 20 bp, Artificial Sequence
  Synthetic construct
taatttctactcttgtagat

SEQ ID NO: 497 - DNA, 4 bp, Artificial Sequence
  Synthetic construct
aacc

SEQ ID NO: 498 - DNA, 9 bp, Artificial Sequence
  Synthetic construct
aauuucuac

SEQ ID NO: 499 - DNA, 9 bp, Artificial Sequence
  Synthetic construct
aatttctac

SEQ ID NO: 500 - DNA, 10 bp, Artificial Sequence
  Synthetic construct
uaauuucuac

SEQ ID NO: 501 - DNA, 10 bp, Artificial Sequence
  Synthetic construct
taatttctac

SEQ ID NO: 502 - DNA, 9 bp, Artificial Sequence
  Synthetic construct
aauuucugc

SEQ ID NO: 503 - DNA, 9 bp, Artificial Sequence
  Synthetic construct
aatttctgc

SEQ ID NO: 504 - DNA, 10 bp, Artificial Sequence
  Synthetic construct
gaauuucuac

SEQ ID NO: 505 - DNA, 10 bp, Artificial Sequence
  Synthetic construct
gaatttctac

SEQ ID NO: 506 - DNA, 9 bp, Artificial Sequence
  Synthetic construct
uaauuucua

SEQ ID NO: 507 - DNA, 9 bp, Artificial Sequence
  Synthetic construct
taatttcta

SEQ ID NO: 508 - DNA, 5 bp, Artificial Sequence
  Synthetic construct
uaagu

SEQ ID NO: 509 - DNA, 5 bp, Artificial Sequence
  Synthetic construct
taagt

SEQ ID NO: 510 - DNA, 4 bp, Artificial Sequence
  Synthetic construct
uguu

SEQ ID NO: 511 - DNA, 4 bp, Artificial Sequence
  Synthetic construct
tgtt

SEQ ID NO: 512 - DNA, 4 bp, Artificial Sequence
  Synthetic construct
ucuu

SEQ ID NO: 513 - DNA, 4 bp, Artificial Sequence
  Synthetic construct
tctt

SEQ ID NO: 514 - DNA, 4 bp, Artificial Sequence
  Synthetic construct
uauu

SEQ ID NO: 515 - DNA, 4 bp, Artificial Sequence
  Synthetic construct
tatt

SEQ ID NO: 516 - DNA, 4 bp, Artificial Sequence
  Synthetic construct
ugcu

SEQ ID NO: 517 - DNA, 4 bp, Artificial Sequence
  Synthetic construct
tgct

SEQ ID NO: 518 - DNA, 3 bp, Artificial Sequence
  Synthetic construct
uuu

SEQ ID NO: 519 - DNA, 3 bp, Artificial Sequence
  Synthetic construct
ttt

SEQ ID NO: 520 - DNA, 6 bp, Artificial Sequence
  Synthetic construct
guagau

SEQ ID NO: 521 - DNA, 6 bp, Artificial Sequence
  Synthetic construct
gtagat

SEQ ID NO: 522 - DNA, 6 bp, Artificial Sequence
  Synthetic construct
gcagau

SEQ ID NO: 523 - DNA, 6 bp, Artificial Sequence
  Synthetic construct
gcagat

SEQ ID NO: 524 - DNA, 6 bp, Artificial Sequence
  Synthetic construct
guggau

SEQ ID NO: 525 - DNA, 6 bp, Artificial Sequence
  Synthetic construct
gtggat

SEQ ID NO: 526 - DNA, 6 bp, Artificial Sequence
  Synthetic construct
guaggu

SEQ ID NO: 527 - DNA, 6 bp, Artificial Sequence
  Synthetic construct
gtaggt

SEQ ID NO: 528 - DNA, 20 bp, Artificial Sequence
  Synthetic construct
aauuucuacuaaguguagau

SEQ ID NO: 529 - DNA, 20 bp, Artificial Sequence
  Synthetic construct
aatttctactaagtgtagat

SEQ ID NO: 530 - DNA, 19 bp, Artificial Sequence
  Synthetic construct
aauuucuacuauuguagau

SEQ ID NO: 531 - DNA, 19 bp, Artificial Sequence
  Synthetic construct
aatttctactattgtagat

SEQ ID NO: 532 - DNA, 20 bp, Artificial Sequence
  Synthetic construct
gaauuucuacuauuguagau

SEQ ID NO: 533 - DNA, 20 bp, Artificial Sequence
  Synthetic construct
gaatttctactattgtagat

SEQ ID NO: 534 - DNA, 21 bp, Artificial Sequence
  Synthetic construct
uaauuucuacuaaguguagau

SEQ ID NO: 535 - DNA, 21 bp, Artificial Sequence
  Synthetic construct
taatttctactaagtgtagat

SEQ ID NO: 536 - DNA, 4 bp, Artificial Sequence
  Synthetic construct
aacc

SEQ ID NO: 537 - DNA, 21 bp, Artificial Sequence
  Synthetic construct
  misc_feature (20)..(20): n can be any targeting portion (V) described herein
  misc_feature (21)..(21): n can be any third portion (D) described herein
aauuucuacuguuguagaunn

SEQ ID NO: 538 - DNA, 21 bp, Artificial Sequence
  Synthetic construct
  misc_feature (20)..(20): n can be any targeting portion (V) described herein
  misc_feature (21)..(21): n can be any third portion (D) described herein
aatttctactgttgtagatnn

SEQ ID NO: 539 - DNA, 21 bp, Artificial Sequence
  Synthetic construct
  misc_feature (20)..(20): n can be any targeting portion (V) described herein
  misc_feature (21)..(21): n can be any third portion (D) described herein
aauuucugcuguugcagaunn

SEQ ID NO: 540 - DNA, 21 bp, Artificial Sequence
  Synthetic construct
  misc_feature (20)..(20): n can be any targeting portion (V) described herein
  misc_feature (21)..(21): n can be any third portion (D) described herein
aatttctgctgttgcagatnn

SEQ ID NO: 541 - DNA, 21 bp, Artificial Sequence
  Synthetic construct
  misc_feature (20)..(20): n can be any targeting portion (V) described herein
  misc_feature (21)..(21): n can be any third portion (D) described herein
aauuuccacuguuguggaunn

SEQ ID NO: 542 - DNA, 21 bp, Artificial Sequence
  Synthetic construct
  misc_feature (20)..(20): n can be any targeting portion (V) described herein
  misc_feature (21)..(21): n can be any third portion (D) described herein
aatttccactgttgtggatnn

SEQ ID NO: 543 - DNA, 21 bp, Artificial Sequence
  Synthetic construct
  misc_feature (20)..(20): n can be any targeting portion (V) described herein
  misc_feature (21)..(21): n can be any third portion (D) described herein
aauuccuacuguuguaggunn

SEQ ID NO: 544 - DNA, 21 bp, Artificial Sequence
  Synthetic construct
  misc_feature (20)..(20): n can be any targeting portion (V) described herein
  misc_feature (21)..(21): n can be any third portion (D) described herein
aattcctactgttgtaggtnn

SEQ ID NO: 545 - DNA, 22 bp, Artificial Sequence
  Synthetic construct
  misc_feature (21)..(21): n can be any targeting portion (V) described herein
  misc_feature (22)..(22): n can be any third portion (D) described herein
uaauuucuacuguuguagaunn

SEQ ID NO: 546 - DNA, 22 bp, Artificial Sequence
  Synthetic construct
  misc_feature (21)..(21): n can be any targeting portion (V) described herein
  misc_feature (22)..(22): n can be any third portion (D) described herein
taatttctactgttgtagatnn

SEQ ID NO: 547 - DNA, 24 bp, Artificial Sequence
  Synthetic construct
  misc_feature (20)..(20): n can be any targeting portion (V) described herein
aauuucuacucuuguagaunaacc

SEQ ID NO: 548 - DNA, 24 bp, Artificial Sequence
  Synthetic construct
  misc_feature (20)..(20): n can be any targeting portion (V) described herein
aatttctactcttgtagatnaacc

SEQ ID NO: 549 - DNA, 22 bp, Artificial Sequence
  Synthetic construct
  misc_feature (21)..(21): n can be any targeting portion (V) described herein
  misc_feature (22)..(22): n can be any third portion (D) described herein
uaauuucuacucuuguagaunn

SEQ ID NO: 550 - DNA, 22 bp, Artificial Sequence
  Synthetic construct
  misc_feature (21)..(21): n can be any targeting portion (V) described herein
  misc_feature (22)..(22): n can be any third portion (D) described herein
taatttctactcttgtagatnn

SEQ ID NO: 551 - DNA, 21 bp, Artificial Sequence
  Synthetic construct
  misc_feature (20)..(20): n can be any targeting portion (V) described herein
  misc_feature (21)..(21): n can be any third portion (D) described herein
aauuucuacucuuguagaunn

SEQ ID NO: 552 - DNA, 21 bp, Artificial Sequence
  Synthetic construct
  misc_feature (20)..(20): n can be any targeting portion (V) described herein
  misc_feature (21)..(21): n can be any third portion (D) described herein
aatttctactcttgtagatnn

SEQ ID NO: 553 - DNA, 25 bp, Artificial Sequence
  Synthetic construct
  misc_feature (21)..(21): n can be any targeting portion (V) described herein
aauuucuacuaaguguagaunaacc

SEQ ID NO: 554 - DNA, 25 bp, Artificial Sequence
  Synthetic construct
  misc_feature (21)..(21): n can be any targeting portion (V) described herein
aatttctactaagtgtagatnaacc

SEQ ID NO: 555 - DNA, 22 bp, Artificial Sequence
  Synthetic construct
  misc_feature (21)..(21): n can be any targeting portion (V) described herein
  misc_feature (22)..(22): n can be any third portion (D) described herein
aauuucuacuaaguguagaunn

SEQ ID NO: 556 - DNA, 22 bp, Artificial Sequence
  Synthetic construct
  misc_feature (21)..(21): n can be any targeting portion (V) described herein
  misc_feature (22)..(22): n can be any third portion (D described herein
aatttctactaagtgtagatnn

SEQ ID NO: 557 - DNA, 21 bp, Artificial Sequence
  Synthetic construct
  misc_feature (20)..(20): n can be any targeting portion (V) described herein
  misc_feature (21)..(21): n can be any third portion (D) described herein
aauuucuacuauuguagaunn

SEQ ID NO: 558 - DNA, 21 bp, Artificial Sequence
  Synthetic construct
  misc_feature (20)..(20): n can be any targeting portion (V) described herein
  misc_feature (21)..(21): n can be any third portion (D) described herein
aatttctactattgtagatnn

SEQ ID NO: 559 - DNA, 22 bp, Artificial Sequence
  Synthetic construct
  misc_feature (21)..(21): n can be any targeting portion (V) described herein
  misc_feature (22)..(22): n can be any third portion (D) described herein
gaauuucuacuauuguagaunn

SEQ ID NO: 560 - DNA, 22 bp, Artificial Sequence
  Synthetic construct
  misc_feature (21)..(21): n can be any targeting portion (V) described herein
  misc_feature (22)..(22): n can be any third portion (D) described herein
gaatttctactattgtagatnn

SEQ ID NO: 561 - DNA, 26 bp, Artificial Sequence
  Synthetic construct
  misc_feature (22)..(22): n can be any targeting portion (V) described herein
uaauuucuacuaaguguagaunaacc

SEQ ID NO: 562 - DNA, 26 bp, Artificial Sequence
  Synthetic construct
  misc_feature (22)..(22): n can be any targeting portion (V) described herein
taatttctactaagtgtagatnaacc

SEQ ID NO: 563 - DNA, 23 bp, Artificial Sequence
  Synthetic construct
  misc_feature (22)..(22): n can be any targeting portion (V) described herein
  misc_feature (23)..(23): n can be any third portion (D) described herein
uaauuucuacuaaguguagaunn

SEQ ID NO: 564 - DNA, 23 bp, Artificial Sequence
  Synthetic construct
  misc_feature (22)..(22): n can be any targeting portion (V) described herein
  misc_feature (23)..(23): n can be any third portion (D) described herein
taatttctactaagtgtagatnn

SEQ ID NO: 565-569 - skipped (5 entries)

SEQ ID NO: 570 - protein, 1129 aa, Alicyclobacillus acidiphilus
MAVKSMKVKLRLDNMPEIRAGLWKLHTEVNAGVRYYTEWLSLLRQENLYRRSPNGDGEQECYKTAEECKAELLERLRARQVENGHCGPAGSDDELLQLARQLYELLVPQAIGAKGDAQQIARKFLSPLADKDAVGGLGIAKAGNKPRWVRMREAGEPGWEEEKAKAEARKSTDRTADVLRALADFGLKPLMRVYTDSDMSSVQWKPLRKGQAVRTWDRDMFQQAIERMMSWESWNQRVGEAYAKLVEQKSRFEQKNFVGQEHLVQLVNQLQQDMKEASHGLESKEQTAHYLTGRALRGSDKVFEKWEKLDPDAPFDLYDTEIKNVQRRNTRRFGSHDLFAKLAEPKYQALWREDASFLTRYAVYNSIVRKLNHAKMFATFTLPDATAHPIWTRFDKLGGNLHQYTFLFNEFGEGRHAIRFQKLLTVEDGVAKEVDDVTVPISMSAQLDDLLPRDPHELVALYFQDYGAEQHLAGEFGGAKIQYRRDQLNHLHARRGARDVYLNLSVRVQSQSEARGERRPPYAAVFRLVGDNHRAFVHFDKLSDYLAEHPDDGKLGSEGLLSGLRVMSVDLGLRTSASISVFRVARKDELKPNSEGRVPFCFPIEGNENLVAVHERSQLLKLPGETESKDLRAIREERQRTLRQLRTQLAYLRLLVRCGSEDVGRRERSWAKLIEQPMDANQMTPDWREAFEDELQKLKSLYGICGDREWTEAVYESVRRVWRHMGKQVRDWRKDVRSGERPKIRGYQKDVVGGNSIEQIEYLERQYKFLKSWSFFGKVSGQVIRAEKGSRFAITLREHIDHAKEDRLKKLADRIIMEALGYVYALDDERGKGKWVAKYPPCQLILLEELSEYQFNNDRPPSENNQLMQWSHRGVFQELLNQAQVHDLLVGTMYAAFSSRFDARTGAPGIRCRRVPARCAREQNPEPFPWWLNKFVAEHKLDGCPLRADDLIPTGEGEFFVSPFSAEEGDFHQIHADLNAAQNLQRRLWSDFDISQIRLRCDWGEVDGEPVLIPRTTGKRTADSYGNKVFYTKTGVTYYERERGKKRRKVFAQEELSEEEAELLVEADEAREKSVVLMRDPSGIINRGDWTRQKEFWSMVNQRIEGYLVKQIRSRVRLQESACENTGDI

SEQ ID NO: 571 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 572 - protein, 1147 aa, Alicyclobacillus kakegawensis
MAVKSIKVKLRLSECPDILAGMWQLHRATNAGVRYYTEWVSLMRQEILYSRGPDGGQQCYMTAEDCQRELLRRLRNRQLHNGRQDQPGTDADLLAISRRLYEILVLQSIGKRGDAQQIASSFLSPLVDPNSKGGRGEAKSGRKPAWQKMRDQGDPRWVAAREKYEQRKAVDPSKEILNSLDALGLRPLFAVFTETYRSGVDWKPLGKSQGVRTWDRDMFQQALERLMSWESWNRRVGEEYARLFQQKMKFEQEHFAEQSHLVKLARALEADMRAASQGFEAKRGTAHQITRRALRGADRVFEIWKSIPEEALFSQYDEVIRQVQAEKRRDFGSHDLFAKLAEPKYQPLWRADETFLTRYALYNGVLRDLEKARQFATFTLPDACVNPIWTRFESSQGSNLHKYEFLFDHLGPGRHAVRFQRLLVVESEGAKERDSVVVPVAPSGQLDKLVLREEEKSSVALHLHDTARPDGFMAEWAGAKLQYERSTLARKARRDKQGMRSWRRQPSMLMSAAQMLEDAKQAGDVYLNISVRVKSPSEVRGQRRPPYAALFRIDDKQRRVTVNYNKLSAYLEEHPDKQIPGAPGLLSGLRVMSVDLGLRTSASISVFRVAKKEEVEALGDGRPPHYYPIHGTDDLVAVHERSHLIQMPGETETKQLRKLREERQAVLRPLFAQLALLRLLVRCGAADERIRTRSWQRLTKQGREFTKRLTPSWREALELELTRLEAYCGRVPDDEWSRIVDRTVIALWRRMGKQVRDWRKQVKSGAKVKVKGYQLDVVGGNSLAQIDYLEQQYKFLRRWSFFARASGLVVRADRESHFAVALRQHIENAKRDRLKKLADRILMEALGYVYEASGPREGQWTAQHPPCQLIILEELSAYRFSDDRPPSENSKLMAWGHRGILEELVNQAQVHDVLVGTVYAAFSSRFDARTGAPGVRCRRVPARFVGATVDDSLPLWLTEFLDKHRLDKNLLRPDDVIPTGEGEFLVSPCGEEAARVRQVHADINAAQNLQRRLWQNFDITELRLRCDVKMGGEGTVLVPRVNNARAKQLFGKKVLVSQDGVTFFERSQTGGKPHSEKQTDLTDKELELIAEADEARAKSVVLFRDPSGHIGKGHWIRQREFWSLVKQRIESHTAERIRVRGVGSSLD

SEQ ID NO: 573 - protein, 1108 aa, Bacillus hisashii
MATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 574-579 - skipped (6 entries)

SEQ ID NO: 580 - DNA, 88 bp, Artificial Sequence
  Synthetic construct
gtctaaaggacagaatttttcaacgggtgtgccaatggccactttccaggtggcaaagcccgttgaacttcccgggacgtctgtaccc

SEQ ID NO: 581 - DNA, 103 bp, Artificial Sequence
  Synthetic construct
aactgtctaaaggacagaatttttcaacgggtgtgccaatggccactttccaggtggcaaagcccgttgaacttctcaaaaagaacgctcgctcagtgttctg

SEQ ID NO: 582 - DNA, 101 bp, Artificial Sequence
  Synthetic construct
ctgtctaaaggacagaatttttcaacgggtgtgccaatggccactttccaggtggcaaagcccgttgaacttctcaaaaagaacgctcgctcagtgttctg

SEQ ID NO: 583 - DNA, 94 bp, Artificial Sequence
  Synthetic construct
gtctaaaggacagaatttttcaacgggtgtgccaatggccactttccaggtggcaaagcccgttgaacttctcaaaaagaacgctcgctcagtg

SEQ ID NO: 584 - DNA, 80 bp, Artificial Sequence
  Synthetic construct
gtctaaaggacagaatttttcaacgggtgtgccaatggccactttccaggtggcaaagcccgttgaacttctcaaaaaga

SEQ ID NO: 585 - DNA, 74 bp, Artificial Sequence
  Synthetic construct
gucuaaaggacagaauuuuucaacgggugugccaauggccacuuuccagguggcaaagcccguugaacuucuca

SEQ ID NO: 586 - DNA, 74 bp, Artificial Sequence
  Synthetic construct
gtctaaaggacagaatttttcaacgggtgtgccaatggccactttccaggtggcaaagcccgttgaacttctca

SEQ ID NO: 587 - DNA, 73 bp, Artificial Sequence
  Synthetic construct
gucuaaaggacagaauuuuucaacgggugugccaauggccacuuuccagguggcaaagcccguugaacuucuc

SEQ ID NO: 588 - DNA, 73 bp, Artificial Sequence
  Synthetic construct
gtctaaaggacagaatttttcaacgggtgtgccaatggccactttccaggtggcaaagcccgttgaacttctc

SEQ ID NO: 589 - DNA, 72 bp, Artificial Sequence
  Synthetic construct
gucuaaaggacagaauuuuucaacgggugugccaauggccacuuuccagguggcaaagcccguugaacuucu

SEQ ID NO: 590 - DNA, 72 bp, Artificial Sequence
  Synthetic construct
gtctaaaggacagaatttttcaacgggtgtgccaatggccactttccaggtggcaaagcccgttgaacttct

SEQ ID NO: 591 - DNA, 71 bp, Artificial Sequence
  Synthetic construct
gucuaaaggacagaauuuuucaacgggugugccaauggccacuuuccagguggcaaagcccguugaacuuc

SEQ ID NO: 592 - DNA, 71 bp, Artificial Sequence
  Synthetic construct
gtctaaaggacagaatttttcaacgggtgtgccaatggccactttccaggtggcaaagcccgttgaacttc

SEQ ID NO: 593 - DNA, 74 bp, Artificial Sequence
  Synthetic construct
gucuagaggacagaauuuuucaacgggugugccaauggccacuuuccagguggcaaagcccguugagcuucuca

SEQ ID NO: 594 - DNA, 74 bp, Artificial Sequence
  Synthetic construct
gtctagaggacagaatttttcaacgggtgtgccaatggccactttccaggtggcaaagcccgttgagcttctca

SEQ ID NO: 595 - DNA, 4 bp, Artificial Sequence
  Synthetic construct
aagc

SEQ ID NO: 596 - DNA, 4 bp, Artificial Sequence
  Synthetic construct
aaac

SEQ ID NO: 597 - DNA, 4 bp, Artificial Sequence
  Synthetic construct
acua

SEQ ID NO: 598 - DNA, 4 bp, Artificial Sequence
  Synthetic construct
acta

SEQ ID NO: 599 - DNA, 4 bp, Artificial Sequence
  Synthetic construct
acgu

SEQ ID NO: 600 - DNA, 4 bp, Artificial Sequence
  Synthetic construct
acgt

SEQ ID NO: 601 - DNA, 4 bp, Artificial Sequence
  Synthetic construct
uuau

SEQ ID NO: 602 - DNA, 4 bp, Artificial Sequence
  Synthetic construct
ttat

SEQ ID NO: 603 - DNA, 4 bp, Artificial Sequence
  Synthetic construct
uuac

SEQ ID NO: 604 - DNA, 4 bp, Artificial Sequence
  Synthetic construct
ttac

SEQ ID NO: 605 - DNA, 4 bp, Artificial Sequence
  Synthetic construct
acga

SEQ ID NO: 606 - DNA, 4 bp, Artificial Sequence
  Synthetic construct
aauc

SEQ ID NO: 607 - DNA, 4 bp, Artificial Sequence
  Synthetic construct
aatc

SEQ ID NO: 608 - DNA, 6 bp, Artificial Sequence
  Synthetic construct
aaaagc

SEQ ID NO: 609 - DNA, 4 bp, Artificial Sequence
  Synthetic construct
aaaa

SEQ ID NO: 610 - DNA, 10 bp, Artificial Sequence
  Synthetic construct
gaaguggcac

SEQ ID NO: 611 - DNA, 10 bp, Artificial Sequence
  Synthetic construct
gaagtggcac

SEQ ID NO: 612 - DNA, 23 bp, Artificial Sequence
  Synthetic construct
ggaguacaaccgggaaguggcac

SEQ ID NO: 613 - DNA, 23 bp, Artificial Sequence
  Synthetic construct
ggagtacaaccgggaagtggcac

SEQ ID NO: 614 - DNA, 34 bp, Artificial Sequence
  Synthetic construct
cggaucacugagcgagcgaucugagaaguggcac

SEQ ID NO: 615 - DNA, 34 bp, Artificial Sequence
  Synthetic construct
cggatcactgagcgagcgatctgagaagtggcac

SEQ ID NO: 616 - DNA, 29 bp, Artificial Sequence
  Synthetic construct
cacugagcgagcgaucugagaaguggcac

SEQ ID NO: 617 - DNA, 29 bp, Artificial Sequence
  Synthetic construct
cactgagcgagcgatctgagaagtggcac

SEQ ID NO: 618 - DNA, 15 bp, Artificial Sequence
  Synthetic construct
ucugagaaguggcac

SEQ ID NO: 619 - DNA, 15 bp, Artificial Sequence
  Synthetic construct
tctgagaagtggcac

SEQ ID NO: 620 - DNA, 13 bp, Artificial Sequence
  Synthetic construct
ugagaaguggcac

SEQ ID NO: 621 - DNA, 13 bp, Artificial Sequence
  Synthetic construct
tgagaagtggcac

SEQ ID NO: 622 - DNA, 12 bp, Artificial Sequence
  Synthetic construct
gagaaguggcac

SEQ ID NO: 623 - DNA, 12 bp, Artificial Sequence
  Synthetic construct
gagaagtggcac

SEQ ID NO: 624 - DNA, 11 bp, Artificial Sequence
  Synthetic construct
agaaguggcac

SEQ ID NO: 625 - DNA, 11 bp, Artificial Sequence
  Synthetic construct
agaagtggcac

SEQ ID NO: 626 - DNA, 10 bp, Artificial Sequence
  Synthetic construct
gaaguggcac

SEQ ID NO: 627 - DNA, 10 bp, Artificial Sequence
  Synthetic construct
gaagtggcac

SEQ ID NO: 628 - DNA, 88 bp, Artificial Sequence
  Synthetic construct
gucgucuauaggacggcgaggacaacgggaagugccaaugugcucuuuccaagagcaaacaccccguuggcuucaagaugaccgcucg

SEQ ID NO: 629 - DNA, 88 bp, Artificial Sequence
  Synthetic construct
gtcgtctataggacggcgaggacaacgggaagtgccaatgtgctctttccaagagcaaacaccccgttggcttcaagatgaccgctcg

SEQ ID NO: 630 - DNA, 102 bp, Artificial Sequence
  Synthetic construct
gucgucuauaggacggcgaggacaacgggaagugccaaugugcucuuuccaagagcaaacaccccguuggcuucaagaugaccgcucgcucagcgaucugac

SEQ ID NO: 631 - DNA, 102 bp, Artificial Sequence
  Synthetic construct
gtcgtctataggacggcgaggacaacgggaagtgccaatgtgctctttccaagagcaaacaccccgttggcttcaagatgaccgctcgctcagcgatctgac

SEQ ID NO: 632 - DNA, 100 bp, Artificial Sequence
  Synthetic construct
gucgucuauaggacggcgaggacaacgggaagugccaaugugcucuuuccaagagcaaacaccccguuggcuucaagaugaccgcucgcucagcgaucug

SEQ ID NO: 633 - DNA, 100 bp, Artificial Sequence
  Synthetic construct
gtcgtctataggacggcgaggacaacgggaagtgccaatgtgctctttccaagagcaaacaccccgttggcttcaagatgaccgctcgctcagcgatctg

SEQ ID NO: 634 - DNA, 4 bp, Artificial Sequence
  Synthetic construct
aaaa

SEQ ID NO: 635 - DNA, 4 bp, Artificial Sequence
  Synthetic construct
aaac

SEQ ID NO: 636 - DNA, 4 bp, Artificial Sequence
  Synthetic construct
uuau

SEQ ID NO: 637 - DNA, 4 bp, Artificial Sequence
  Synthetic construct
ttat

SEQ ID NO: 638 - DNA, 4 bp, Artificial Sequence
  Synthetic construct
uuac

SEQ ID NO: 639 - DNA, 4 bp, Artificial Sequence
  Synthetic construct
ttac

SEQ ID NO: 640 - DNA, 23 bp, Artificial Sequence
  Synthetic construct
cgagcggucugagaaguggcacu

SEQ ID NO: 641 - DNA, 23 bp, Artificial Sequence
  Synthetic construct
cgagcggtctgagaagtggcact

SEQ ID NO: 642 - DNA, 36 bp, Artificial Sequence
  Synthetic construct
aacggaucgcugagcgagcggucugagaaguggcac

SEQ ID NO: 643 - DNA, 36 bp, Artificial Sequence
  Synthetic construct
aacggatcgctgagcgagcggtctgagaagtggcac

SEQ ID NO: 644 - DNA, 34 bp, Artificial Sequence
  Synthetic construct
cggaucgcugagcgagcggucugagaaguggcac

SEQ ID NO: 645 - DNA, 34 bp, Artificial Sequence
  Synthetic construct
cggatcgctgagcgagcggtctgagaagtggcac

SEQ ID NO: 646 - DNA, 85 bp, Artificial Sequence
  Synthetic construct
acgagguucugucuuuuggucaggacaaccgucuagcuauaagugcugcagggugugagaaacuccuauugcuggacgaugucuc

SEQ ID NO: 647 - DNA, 84 bp, Artificial Sequence
  Synthetic construct
acgaggttctgtctttggtcaggacaaccgtctagctataagtgctgcagggtgtgagaaactcctattgctggacgatgtctc

SEQ ID NO: 648 - DNA, 80 bp, Artificial Sequence
  Synthetic construct
guucugucuuuuggucaggacaaccgucuagcuauaagugcugcagggugugagaaacuccuauugcuggacgaugucuc

SEQ ID NO: 649 - DNA, 80 bp, Artificial Sequence
  Synthetic construct
gttctgtcttttggtcaggacaaccgtctagctataagtgctgcagggtgtgagaaactcctattgctggacgatgtctc

SEQ ID NO: 650 - DNA, 80 bp, Artificial Sequence
  Synthetic construct
guucugucuuuuggucaggacaaccgucuagcuauaagugcugcagggugugagaaacuccuauugcuggacgacgccuc

SEQ ID NO: 651 - DNA, 80 bp, Artificial Sequence
  Synthetic construct
gttctgtcttttggtcaggacaaccgtctagctataagtgctgcagggtgtgagaaactcctattgctggacgacgcctc

SEQ ID NO: 652 - DNA, 78 bp, Artificial Sequence
  Synthetic construct
guucugucuuuuggucaggacaaccgucuagcuauaagugcugcagggugugagaaacuccuauugcuggacgacgcc

SEQ ID NO: 653 - DNA, 78 bp, Artificial Sequence
  Synthetic construct
gttctgtcttttggtcaggacaaccgtctagctataagtgctgcagggtgtgagaaactcctattgctggacgacgcc

SEQ ID NO: 654 - DNA, 77 bp, Artificial Sequence
  Synthetic construct
guucugucuuuuggucaggacaaccgucuagcuauaagugcugcagggugcagaaacuccuauugcuggacgacgcc

SEQ ID NO: 655 - DNA, 77 bp, Artificial Sequence
  Synthetic construct
gttctgtcttttggtcaggacaaccgtctagctataagtgctgcagggtgcagaaactcctattgctggacgacgcc

SEQ ID NO: 656 - DNA, 88 bp, Artificial Sequence
  Synthetic construct
guucugucuuuuggucaggacaaccgucuagcuauaagugcugcagggugcagaaacuccuauugcuggacgacgccucauuuauuuc

SEQ ID NO: 657 - DNA, 88 bp, Artificial Sequence
  Synthetic construct
gttctgtcttttggtcaggacaaccgtctagctataagtgctgcagggtgcagaaactcctattgctggacgacgcctcatttatttc

SEQ ID NO: 658 - DNA, 4 bp, Artificial Sequence
  Synthetic construct
aaaa

SEQ ID NO: 659 - DNA, 4 bp, Artificial Sequence
  Synthetic construct
aaac

SEQ ID NO: 660 - DNA, 4 bp, Artificial Sequence
  Synthetic construct
uuau

SEQ ID NO: 661 - DNA, 4 bp, Artificial Sequence
  Synthetic construct
ttat

SEQ ID NO: 662 - DNA, 4 bp, Artificial Sequence
  Synthetic construct
uuac

SEQ ID NO: 663 - DNA, 4 bp, Artificial Sequence
  Synthetic construct
ttac

SEQ ID NO: 664 - DNA, 13 bp, Artificial Sequence
  Synthetic construct
gaggcauuagcac

SEQ ID NO: 665 - DNA, 13 bp, Artificial Sequence
  Synthetic construct
gaggcattagcac

SEQ ID NO: 666 - DNA, 13 bp, Artificial Sequence
  Synthetic construct
gaggcguuagcac

SEQ ID NO: 667 - DNA, 13 bp, Artificial Sequence
  Synthetic construct
gaggcgttagcac

SEQ ID NO: 668 - DNA, 11 bp, Artificial Sequence
  Synthetic construct
ggcguuagcac

SEQ ID NO: 669 - DNA, 11 bp, Artificial Sequence
  Synthetic construct
ggcgttagcac

SEQ ID NO: 670 - DNA, 23 bp, Artificial Sequence
  Synthetic construct
gaaauguuacgaggcguuagcac

SEQ ID NO: 671 - DNA, 23 bp, Artificial Sequence
  Synthetic construct
gaaatgttacgaggcgttagcac

SEQ ID NO: 672 - DNA, 87 bp, Artificial Sequence
  Synthetic construct
  misc_feature (86)..(86): n can be any targeting portion (V) described herein
  misc_feature (87)..(87): n can be any third portion (D) described herein
gtctaaaggacagaatttttcaacgggtgtgccaatggccactttccaggtggcaaagcccgttgaacttcaagcgaagtggcacnn

SEQ ID NO: 673 - DNA, 117 bp, Artificial Sequence
  Synthetic construct
  misc_feature (116)..(116): n can be any targeting portion (V) described herein
  misc_feature (117)..(117): n can be any third portion (D) described herein
gtctaaaggacagaatttttcaacgggtgtgccaatggccactttccaggtggcaaagcccgttgaacttcccgggacgtctgtacccactaggagtacaaccgggaagtggcacnn

SEQ ID NO: 674 - DNA, 143 bp, Artificial Sequence
  Synthetic construct
  misc_feature (142)..(142): n can be any targeting portion (V) described herein
  misc_feature (143)..(143): n can be any third portion (D) described herein
aactgtctaaaggacagaatttttcaacgggtgtgccaatggccactttccaggtggcaaagcccgttgaacttctcaaaaagaacgctcgctcagtgttctgacgtcggatcactgagcgagcgatctgagaagtggcacnn

SEQ ID NO: 675 - DNA, 129 bp, Artificial Sequence
  Synthetic construct
  misc_feature (128)..(128): n can be any targeting portion (V) described herein
  misc_feature (129)..(129): n can be any third portion (D) described herein
gtctaaaggacagaatttttcaacgggtgtgccaatggccactttccaggtggcaaagcccgttgaacttctcaaaaagaacgctcgctcagtgttatcactgagcgagcgatctgagaagtggcacnn

SEQ ID NO: 676 - DNA, 141 bp, Artificial Sequence
  Synthetic construct
  misc_feature (140)..(140): n can be any targeting portion (V) described herein
  misc_feature (141)..(141): n can be any third portion (D) described herein
ctgtctaaaggacagaatttttcaacgggtgtgccaatggccactttccaggtggcaaagcccgttgaacttctcaaaaagaacgctcgctcagtgttctgacgtcggatcactgagcgagcgatctgagaagtggcacnn

SEQ ID NO: 677 - DNA, 101 bp, Artificial Sequence
  Synthetic construct
  misc_feature (100)..(100): n can be any targeting portion (V) described herein
  misc_feature (101)..(101): n can be any third portion (D) described herein
gtctaaaggacagaatttttcaacgggtgtgccaatggccactttccaggtggcaaagcccgttgaacttctcaaaaagaacgatctgagaagtggcacnn

SEQ ID NO: 678 - DNA, 95 bp, Artificial Sequence
  Synthetic construct
  misc_feature (94)..(94): n can be any targeting portion (V) described herein
  misc_feature (95)..(95): n can be any third portion (D) described herein
gtctaaaggacagaatttttcaacgggtgtgccaatggccactttccaggtggcaaagcccgttgaacttctcaaaaagctgagaagtggcacnn

SEQ ID NO: 679 - DNA, 93 bp, Artificial Sequence
  Synthetic construct
  misc_feature (92)..(92): n can be any targeting portion (V) described herein
  misc_feature (93)..(93): n can be any third portion (D) described herein
gtctaaaggacagaatttttcaacgggtgtgccaatggccactttccaggtggcaaagcccgttgaacttctcaaagctgagaagtggcacnn

SEQ ID NO: 680 - DNA, 93 bp, Artificial Sequence
  Synthetic construct
  misc_feature (92)..(92): n can be any targeting portion (V) described herein
  misc_feature (93)..(93): n can be any third portion (D) described herein
gtctaaaggacagaatttttcaacgggtgtgccaatggccactttccaggtggcaaagcccgttgaacttctcaaaactgagaagtggcacnn

SEQ ID NO: 681 - DNA, 91 bp, Artificial Sequence
  Synthetic construct
  misc_feature (90)..(90): n can be any targeting portion (V) described herein
  misc_feature (91)..(91): n can be any third portion (D) described herein
gtctaaaggacagaatttttcaacgggtgtgccaatggccactttccaggtggcaaagcccgttgaacttctcaagcgagaagtggcacnn

SEQ ID NO: 682 - DNA, 89 bp, Artificial Sequence
  Synthetic construct
  misc_feature (88)..(88): n can be any targeting portion (V) described herein
  misc_feature (89)..(89): n can be any third portion (D) described herein
gtctaaaggacagaatttttcaacgggtgtgccaatggccactttccaggtggcaaagcccgttgaacttctaagcagaagtggcacnn

SEQ ID NO: 683 - DNA, 89 bp, Artificial Sequence; identical to SEQ ID NO: 682
  Synthetic construct
  misc_feature (88)..(88): n can be any targeting portion (V) described herein
  misc_feature (89)..(89): n can be any third portion (D) described herein

SEQ ID NO: 684 - DNA, 87 bp, Artificial Sequence; identical to SEQ ID NO: 672
  Synthetic construct
  misc_feature (86)..(86): n can be any targeting portion (V) described herein
  misc_feature (87)..(87): n can be any third portion (D) described herein

SEQ ID NO: 685 - DNA, 93 bp, Artificial Sequence
  Synthetic construct
  misc_feature (92)..(92): n can be any targeting portion (V) described herein
  misc_feature (93)..(93): n can be any third portion (D) described herein
gtctagaggacagaatttttcaacgggtgtgccaatggccactttccaggtggcaaagcccgttgagcttctcaaatctgagaagtggcacnn

SEQ ID NO: 686 - DNA, 117 bp, Artificial Sequence
  Synthetic construct
  misc_feature (116)..(116): n can be any targeting portion (V) described herein
  misc_feature (117)..(117): n can be any third portion (D) described herein
gucgucuauaggacggcgaggacaacgggaagugccaaugugcucuuuccaagagcaaacaccccguuggcuucaagaugaccgcucgaaaacgagcggucugagaaguggcacunn

SEQ ID NO: 687 - DNA, 117 bp, Artificial Sequence
  Synthetic construct
  misc_feature (116)..(116): n can be any targeting portion (V) described herein
  misc_feature (117)..(117): n can be any third portion (D) described herein
gtcgtctataggacggcgaggacaacgggaagtgccaatgtgctctttccaagagcaaacaccccgttggcttcaagatgaccgctcgaaaacgagcggtctgagaagtggcactnn

SEQ ID NO: 688 - DNA, 117 bp, Artificial Sequence
  Synthetic construct
  misc_feature (116)..(116): n can be any targeting portion (V) described herein
  misc_feature (117)..(117): n can be any third portion (D) described herein
gtcgtctataggacggcgaggacaacgggaagtgccaatgtgctctttccaagagcaaacaccccgttggcttcaagatgaccgctcgttaccgagcggtctgagaagtggcactnn

SEQ ID NO: 689 - DNA, 144 bp, Artificial Sequence
  Synthetic construct
  misc_feature (143)..(143): n can be any targeting portion (V) described herein
  misc_feature (144)..(144): n can be any third portion (D) described herein
gtcgtctataggacggcgaggacaacgggaagtgccaatgtgctctttccaagagcaaacaccccgttggcttcaagatgaccgctcgctcagcgatctgacttacaacggatcgctgagcgagcggtctgagaagtggcacnn

SEQ ID NO: 690 - DNA, 140 bp, Artificial Sequence
  Synthetic construct
  misc_feature (139)..(139): n can be any targeting portion (V) described herein
  misc_feature (140)..(140): n can be any third portion (D) described herein
gtcgtctataggacggcgaggacaacgggaagtgccaatgtgctctttccaagagcaaacaccccgttggcttcaagatgaccgctcgctcagcgatctgaaaacggatcgctgagcgagcggtctgagaagtggcacnn

SEQ ID NO: 691 - DNA, 104 bp, Artificial Sequence
  Synthetic construct
  misc_feature (04)..(104): n can be any third portion (D) described herein
  misc_feature (103)..(103): n can be any targeting portion (V) described herein
acgaggttctgtcttttggtcaggacaaccgtctagctataagtgctgcagggtgtgagaaactcctattgctggacgatgtctcttacgaggcattagcacnn

SEQ ID NO: 692 - DNA, 99 bp, Artificial Sequence
  Synthetic construct
  misc_feature (98)..(98): n can be any targeting portion (V) described herein
  misc_feature (99)..(99): n can be any third portion (D) described herein
guucugucuuuuggucaggacaaccgucuagcuauaagugcugcagggugugagaaacuccuauugcuggacgaugucucuuacgaggcauuagcacnn

SEQ ID NO: 693 - DNA, 99 bp, Artificial Sequence
  Synthetic construct
  misc_feature (98)..(98): n can be any targeting portion (V) described herein
  misc_feature (99)..(99): n can be any third portion (D) described herein
gttctgtcttttggtcaggacaaccgtctagctataagtgctgcagggtgtgagaaactcctattgctggacgatgtctcttacgaggcattagcacnn

SEQ ID NO: 694 - DNA, 99 bp, Artificial Sequence
  Synthetic construct
  misc_feature (98)..(98): n can be any targeting portion (V) described herein
  misc_feature (99)..(99): n can be any third portion (D) described herein
guucugucuuuuggucaggacaaccgucuagcuauaagugcugcagggugugagaaacuccuauugcuggacgacgccucuuacgaggcguuagcacnn

SEQ ID NO: 695 - DNA, 99 bp, Artificial Sequence
  Synthetic construct
  misc_feature (98)..(98): n can be any targeting portion (V) described herein
  misc_feature (99)..(99): n can be any third portion (D) described herein
gttctgtcttttggtcaggacaaccgtctagctataagtgctgcagggtgtgagaaactcctattgctggacgacgcctcttacgaggcgttagcacnn

SEQ ID NO: 696 - DNA, 97 bp, Artificial Sequence
  Synthetic construct
  misc_feature (96)..(96): n can be any targeting portion (V) described herein
  misc_feature (97)..(97): n can be any third portion (D) described herein
gttctgtcttttggtcaggacaaccgtctagctataagtgctgcagggtgtgagaaactcctattgctggacgacgccttacgaggcgttagcacnn

SEQ ID NO: 697 - DNA, 94 bp, Artificial Sequence
  Synthetic construct
  misc_feature (93)..(93): n can be any targeting portion (V) described herein
  misc_feature (94)..(94): n can be any third portion (D) described herein
guucugucuuuuggucaggacaaccgucuagcuauaagugcugcagggugcagaaacuccuauugcuggacgacgccuuacggcguuagcacnn

SEQ ID NO: 698 - DNA, 94 bp, Artificial Sequence
  Synthetic construct
  misc_feature (93)..(93): n can be any targeting portion (V) described herein
  misc_feature (94)..(94): n can be any third portion (D) described herein
gttctgtcttttggtcaggacaaccgtctagctataagtgctgcagggtgcagaaactcctattgctggacgacgccttacggcgttagcacnn

SEQ ID NO: 699 - DNA, 117 bp, Artificial Sequence
  Synthetic construct
  misc_feature (116)..(116): n can be any targeting portion (V) described herein
  misc_feature (117)..(117): n can be any third portion (D) described herein
gttctgtcttttggtcaggacaaccgtctagctataagtgctgcagggtgcagaaactcctattgctggacgacgcctcatttatttcaaaagaaatgttacgaggcgttagcacnn

SEQ ID NO: 700 - protein, 1125 aa, Candidatus Katanobacteria
MRKKLFKGYILHNKRLVYTGKAAIRSIKYPLVAPNKTALNNLSEKIIYDYEHLFGPLNVASYARNSNRYSLVDFWIDSLRAGVIWQSKSTSLIDLISKLEGSKSPSEKIFEQIDFELKNKLDKEQFKDIILLNTGIRSSSNVRSLRGRFLKCFKEEFRDTEEVIACVDKWSKDLIVEGKSILVSKQFLYWEEEFGIKIFPHFKDNHDLPKLTFFVEPSLEFSPHLPLANCLERLKKFDISRESLLGLDNNFSAFSNYFNELFNLLSRGEIKKIVTAVLAVSKSWENEPELEKRLHFLSEKAKLLGYPKLTSSWADYRMIIGGKIKSWHSNYTEQLIKVREDLKKHQIALDKLQEDLKKVVDSSLREQIEAQREALLPLLDTMLKEKDFSDDLELYRFILSDFKSLLNGSYQRYIQTEEERKEDRDVTKKYKDLYSNLRNIPRFFGESKKEQFNKFINKSLPTIDVGLKILEDIRNALETVSVRKPPSITEEYVTKQLEKLSRKYKINAFNSNRFKQITEQVLRKYNNGELPKISEVFYRYPRESHVAIRILPVKISNPRKDISYLLDKYQISPDWKNSNPGEVVDLIEIYKLTLGWLLSCNKDFSMDFSSYDLKLFPEAASLIKNFGSCLSGYYLSKMIFNCITSEIKGMITLYTRDKFVVRYVTQMIGSNQKFPLLCLVGEKQTKNFSRNWGVLIEEKGDLGEEKNQEKCLIFKDKTDFAKAKEVEIFKNNIWRIRTSKYQIQFLNRLFKKTKEWDLMNLVLSEPSLVLEEEWGVSWDKDKLLPLLKKEKSCEERLYYSLPLNLVPATDYKEQSAEIEQRNTYLGLDVGEFGVAYAVVRIVRDRIELLSWGFLKDPALRKIRERVQDMKKKQVMAVFSSSSTAVARVREMAIHSLRNQIHSIALAYKAKIIYEISISNFETGGNRMAKIYRSIKVSDVYRESGADTLVSEMIWGKKNKQMGNHISSYATSYTCCNCARTPFELVIDNDKEYEKGGDEFIFNVGDEKKVRGFLQKSLLGKTIKGKEVLKSIKEYARPPIREVLLEGEDVEQLLKRRGNSYIYRCPFCGYKTDADIQAALNIACRGYISDNAKDAVKEGERKLDYILEVRKLWEKNGAVLRSAKFL

SEQ ID NO: 701 - protein, 1226 aa, Candidatus Vogelbacteria
MQKVRKTLSEVHKNPYGTKVRNAKTGYSLQIERLSYTGKEGMRSFKIPLENKNKEVFDEFVKKIRNDYISQVGLLNLSDWYEHYQEKQEHYSLADFWLDSLRAGVIFAHKETEIKNLISKIRGDKSIVDKFNASIKKKHADLYALVDIKALYDFLTSDARRGLKTEEEFFNSKRNTLFPKFRKKDNKAVDLWVKKFIGLDNKDKLNFTKKFIGFDPNPQIKYDHTFFFHQDINFDLERITTPKELISTYKKFLGKNKDLYGSDETTEDQLKMVLGFHNNHGAFSKYFNASLEAFRGRDNSLVEQIINNSPYWNSHRKELEKRIIFLQVQSKKIKETELGKPHEYLASFGGKFESWVSNYLRQEEEVKRQLFGYEENKKGQKKFIVGNKQELDKIIRGTDEYEIKAISKETIGLTQKCLKLLEQLKDSVDDYTLSLYRQLIVELRIRLNVEFQETYPELIGKSEKDKEKDAKNKRADKRYPQIFKDIKLIPNFLGETKQMVYKKFIRSADILYEGINFIDQIDKQITQNLLPCFKNDKERIEFTEKQFETLRRKYYLMNSSRFHHVIEGIINNRKLIEMKKRENSELKTFSDSKFVLSKLFLKKGKKYENEVYYTFYINPKARDQRRIKIVLDINGNNSVGILQDLVQKLKPKWDDIIKKNDMGELIDAIEIEKVRLGILIALYCEHKFKIKKELLSLDLFASAYQYLELEDDPEELSGTNLGRFLQSLVCSEIKGAINKISRTEYIERYTVQPMNTEKNYPLLINKEGKATWHIAAKDDLSKKKGGGTVAMNQKIGKNFFGKQDYKTVFMLQDKRFDLLTSKYHLQFLSKTLDTGGGSWWKNKNIDLNLSSYSFIFEQKVKVEWDLTNLDHPIKIKPSENSDDRRLFVSIPFVIKPKQTKRKDLQTRVNYMGIDIGEYGLAWTIINIDLKNKKINKISKQGFIYEPLTHKVRDYVATIKDNQVRGTFGMPDTKLARLRENAITSLRNQVHDIAMRYDAKPVYEFEISNFETGSNKVKVIYDSVKRADIGRGQNNTEADNTEVNLVWGKTSKQFGSQIGAYATSYICSFCGYSPYYEFENSKSGDEEGARDNLYQMKKLSRPSLEDFLQGNPVYKTFRDFDKYKNDQRLQKTGDKDGEWKTHRGNTAIYACQKCRHISDADIQASYWIALKQVVRDFYKDKEMDGDLIQGDNKDKRKVNELNRLIGVHKDVPIINKNLITSLDINLL

SEQ ID NO: 702 - protein, 1160 aa, Candidatus Vogelbacteria
MKAKKSFYNQKRKFGKRGYRLHDERIAYSGGIGSMRSIKYELKDSYGIAGLRNRIADATISDNKWLYGNINLNDYLEWRSSKTDKQIEDGDRESSLLGFWLEALRLGFVFSKQSHAPNDFNETALQDLFETLDDDLKHVLDRKKWCDFIKIGTPKTNDQGRLKKQIKNLLKGNKREEIEKTLNESDDELKEKINRIADVFAKNKSDKYTIFKLDKPNTEKYPRINDVQVAFFCHPDFEEITERDRTKTLDLIINRFNKRYEITENKKDDKTSNRMALYSLNQGYIPRVLNDLFLFVKDNEDDFSQFLSDLENFFSFSNEQIKIIKERLKKLKKYAEPIPGKPQLADKWDDYASDFGGKLESWYSNRIEKLKKIPESVSDLRNNLEKIRNVLKKQNNASKILELSQKIIEYIRDYGVSFEKPEIIKFSWINKTKDGQKKVFYVAKMADREFIEKLDLWMADLRSQLNEYNQDNKVSFKKKGKKIEELGVLDFALNKAKKNKSTKNENGWQQKLSESIQSAPLFFGEGNRVRNEEVYNLKDLLFSEIKNVENILMSSEAEDLKNIKIEYKEDGAKKGNYVLNVLARFYARFNEDGYGGWNKVKTVLENIAREAGTDFSKYGNNNNRNAGRFYLNGRERQVFTLIKFEKSITVEKILELVKLPSLLDEAYRDLVNENKNHKLRDVIQLSKTIMALVLSHSDKEKQIGGNYIHSKLSGYNALISKRDFISRYSVQTTNGTQCKLAIGKGKSKKGNEIDRYFYAFQFFKNDDSKINLKVIKNNSHKNIDFNDNENKINALQVYSSNYQIQFLDWFFEKHQGKKTSLEVGGSFTIAEKSLTIDWSGSNPRVGFKRSDTEEKRVFVSQPFTLIPDDEDKERRKERMIKTKNRFIGIDIGEYGLAWSLIEVDNGDKNNRGIRQLESGFITDNQQQVLKKNVKSWRQNQIRQTFTSPDTKIARLRESLIGSYKNQLESLMVAKKANLSFEYEVSGFEVGGKRVAKIYDSIKRGSVRKKDNNSQNDQSWGKKGINEWSFETTAAGTSQFCTHCKRWSSLAIVDIEEYELKDYNDNLFKVKINDGEVRLLGKKGWRSGEKIKGKELFGPVKDAMRPNVDGLGMKIVKRKYLKLDLRDWVSRYGNMAIFICPYVDCHHISHADKQAAFNIAV

SEQ ID NO: 703 - protein, 1210 aa, Candidatus Parcubacteria
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 704 - protein, 1192 aa, Candidatus Komeilibacteria
MAESKQMQCRKCGASMKYEVIGLGKKSCRYMCPDCGNHTSARKIQNKKKRDKKYGSASKAQSQRIAVAGALYPDKKVQTIKTYKYPADLNGEVHDSGVAEKIAQAIQEDEIGLLGPSSEYACWIASQKQSEPYSVVDFWFDAVCAGGVFAYSGARLLSTVLQLSGEESVLRAALASSPFVDDINLAQAEKFLAVSRRTGQDKLGKRIGECFAEGRLEALGIKDRMREFVQAIDVAQTAGQRFAAKLKIFGISQMPEAKQWNNDSGLTVCILPDYYVPEENRADQLVVLLRRLREIAYCMGIEDEAGFEHLGIDPGALSNFSNGNPKRGFLGRLLNNDIIALANNMSAMTPYWEGRKGELIERLAWLKHRAEGLYLKEPHFGNSWADHRSRIFSRIAGWLSGCAGKLKIAKDQISGVRTDLFLLKRLLDAVPQSAPSPDFIASISALDRFLEAAESSQDPAEQVRALYAFHLNAPAVRSIANKAVQRSDSQEWLIKELDAVDHLEFNKAFPFFSDTGKKKKKGANSNGAPSEEEYTETESIQQPEDAEQEVNGQEGNGASKNQKKFQRIPRFFGEGSRSEYRILTEAPQYFDMFCNNMRAIFMQLESQPRKAPRDFKCFLQNRLQKLYKQTFLNARSNKCRALLESVLISWGEFYTYGANEKKFRLRHEASERSSDPDYVVQQALEIARRLFLFGFEWRDCSAGERVDLVEIHKKAISFLLAITQAEVSVGSYNWLGNSTVSRYLSVAGTDTLYGTQLEEFLNATVLSQMRGLAIRLSSQELKDGFDVQLESSCQDNLQHLLVYRASRDLAACKRATCPAELDPKILVLPVGAFIASVMKMIERGDEPLAGAYLRHRPHSFGWQIRVRGVAEVGMDQGTALAFQKPTESEPFKIKPFSAQYGPVLWLNSSSYSQSQYLDGFLSQPKNWSMRVLPQAGSVRVEQRVALIWNLQAGKMRLERSGARAFFMPVPFSFRPSGSGDEAVLAPNRYLGLFPHSGGIEYAVVDVLDSAGFKILERGTIAVNGFSQKRGERQEEAHREKQRRGISDIGRKKPVQAEVDAANELHRKYTDVATRLGCRIVVQWAPQPKPGTAPTAQTVYARAVRTEAPRSGNQEDHARMKSSWGYTWGTYWEKRKPEDILGISTQVYWTGGIGESCPAVAVALLGHIRATSTQTEWEKEEVVFGRLKKFFPS

SEQ ID NO: 705 - protein, 1192 aa, Candidatus Kerfeldbacteria
MAESKQMQCRKCGASMKYEVIGLGKKSCRYMCPDCGNHTSARKIQNKKKRDKKYGSASKAQSQRIAVAGALYPDKKVQTIKTYKYPADLNGEVHDRGVAEKIEQAIQEDEIGLLGPSSEYACWIASQKQSEPYSVVDFWFDAVCAGGVFAYSGARLLSTVLQLSGEESVLRAALASSPFVDDINLAQAEKFLAVSRRTGQDKLGKRIGECFAEGRLEALGIKDRMREFVQAIDVAQTAGQRFAAKLKIFGISQMPEAKQWNNDSGLTVCILPDYYVPEENRADQLVVLLRRLREIAYCMGIEDEAGFEHLGIDPGALSNFSNGNPKRGFLGRLLNNDIIALANNMSAMTPYWEGRKGELIERLAWLKHRAEGLYLKEPHFGNSWADHRSRIFSRIAGWLSGCAGKLKIAKDQISGVRTDLFLLKRLLDAVPQSAPSPDFIASISALDRFLEAAESSQDPAEQVRALYAFHLNAPAVRSIANKAVQRSDSQEWLIKELDAVDHLEFNKAFPFFSDTGKKKKKGANSNGAPSEEEYTETESIQQPEDAEQEVNGQEGNGASKNQKKFQRIPRFFGEGSRSEYRILTEAPQYFDMFCNNMRAIFMQLESQPRKAPRDFKCFLQNRLQKLYKQTFLNARSNKCRALLESVLISWGEFYTYGANEKKFRLRHEASERSSDPDYVVQQALEIARRLFLFGFEWRDCSAGERVDLVEIHKKAISFLLAITQAEVSVGSYNWLGNSTVSRYLSVAGTDTLYGTQLEEFLNATVLSQMRGLAIRLSSQELKDGFDVQLESSCQDNLQHLLVYRASRDLAACKRATCPAELDPKILVLPAGAFIASVMKMIERGDEPLAGAYLRHRPHSFGWQIRVRGVAEVGMDQGTALAFQKPTESEPFKIKPFSAQYGPVLWLNSSSYSQSQYLDGFLSQPKNWSMRVLPQAGSVRVEQRVALIWNLQAGKMRLERSGARAFFMPVPFSFRPSGSGDEAVLAPNRYLGLFPHSGGIEYAVVDVLDSAGFKILERGTIAVNGFSQKRGERQEEAHREKQRRGISDIGRKKPVQAEVDAANELHRKYTDVATRLGCRIVVQWAPQPKPGTAPTAQTVYARAVRTEAPRSGNQEDHARMKSSWGYTWSTYWEKRKPEDILGISTQVYWTGGIGESCPAVAVALLGHIRATSTQTEWEKEEVVFGRLKKFFPS

SEQ ID NO: 706 - protein, 1287 aa, Candidatus Kerfeldbacteria
MKRILNSLKVAALRLLFRGKGSELVKTVKYPLVSPVQGAVEELAEAIRHDNLHLFGQKEIVDLMEKDEGTQVYSVVDFWLDTLRLGMFFSPSANALKITLGKFNSDQVSPFRKVLEQSPFFLAGRLKVEPAERILSVEIRKIGKRENRVENYAADVETCFIGQLSSDEKQSIQKLANDIWDSKDHEEQRMLKADFFAIPLIKDPKAVTEEDPENETAGKQKPLELCVCLVPELYTRGFGSIADFLVQRLTLLRDKMSTDTAEDCLEYVGIEEEKGNGMNSLLGTFLKNLQGDGFEQIFQFMLGSYVGWQGKEDVLRERLDLLAEKVKRLPKPKFAGEWSGHRMFLHGQLKSWSSNFFRLFNETRELLESIKSDIQHATMLISYVEEKGGYHPQLLSQYRKLMEQLPALRTKVLDPEIEMTHMSEAVRSYIMIHKSVAGFLPDLLESLDRDKDREFLLSIFPRIPKIDKKTKEIVAWELPGEPEEGYLFTANNLFRNFLENPKHVPRFMAERIPEDWTRLRSAPVWFDGMVKQWQKVVNQLVESPGALYQFNESFLRQRLQAMLTVYKRDLQTEKFLKLLADVCRPLVDFFGLGGNDIIFKSCQDPRKQWQTVIPLSVPADVYTACEGLAIRLRETLGFEWKNLKGHEREDFLRLHQLLGNLLFWIRDAKLVVKLEDWMNNPCVQEYVEARKAIDLPLEIFGFEVPIFLNGYLFSELRQLELLLRRKSVMTSYSVKTTGSPNRLFQLVYLPLNPSDPEKKNSNNFQERLDTPTGLSRRFLDLTLDAFAGKLLTDPVTQELKTMAGFYDHLFGFKLPCKLAAMSNHPGSSSKMVVLAKPKKGVASNIGFEPIPDPAHPVFRVRSSWPELKYLEGLLYLPEDTPLTIELAETSVSCQSVSSVAFDLKNLTTILGRVGEFRVTADQPFKLTPIIPEKEESFIGKTYLGLDAGERSGVGFAIVTVDGDGYEVQRLGVHEDTQLMALQQVASKSLKEPVFQPLRKGTFRQQERIRKSLRGCYWNFYHALMIKYRAKVVHEESVGSSGLVGQWLRAFQKDLKKADVLPKKGGKNGVDKKKRESSAQDTLWGGAFSKKEEQQIAFEVQAAGSSQFCLKCGWWFQLGMREVNRVQESGVVLDWNRSIVTFLIESSGEKVYGFSPQQLEKGFRPDIETFKKMVRDFMRPPMFDRKGRPAAAYERFVLGRRHRRYRFDKVFEERFGRSALFICPRVGCGNFDHSSEQSAVVLALIGYIADKEGMSGKKLVYVRLAELMAEWKLKKLERSRVEEQSSAQ

SEQ ID NO: 707 - protein, 1193 aa, Unknown
  uncultivated microbe
MKRIAKFRHDKPVKREAWSKGYRVHKNRIINKVTRSIKYPLVVKDEWKKRLIDDAAHDYRWLVGPINYSDWCRDPNQYSILEFWIDFLCVGGVFQSSHSNICRLAIQLSGGSVFEQEWKDLSPFVRANLIQGIKPAEFIGFLTAEFRSSSNPKNFISKFFEGSNEDLESLTNEFASIVDFIKAKDISLLRKSLPSCKKIAPNLWEKAVGSHSTNELLKLLTKYTRVMLVAEPSHSDRVFSQTVLQSNDQDDPELTGPLPSHKVGKASYLFIPEFIREVNLDKISKLDLSAKSKLAVEQVKKLSELTSDFKQIENQSEAYFGLSTSFNELSNFLGILIRTLRNAPEAILKDQIALCAPLDKDILKITLDWLCDRAQALPENPRFETNWAEYRSYLGGKIKSWFSNYENFFEIPQAASSQQNNNREKKLGNRSAIRALNLKKEAFEKARETFKGDKGTLEKIDLAYRLLGSISPEVLQCDEGLKLYQQFNDELLVLNETINQKFQDAKRDIKAKKEKESFEKLQRNLSSPLPRIPEFFGERAKKGYQKARVSPKLARHLLECLNDWLARFAKVEESAFSEKEFQRILDWLRTSDFLPVFIRKSKDPPSWLRYIARVATGKYYFWVSEYSRKRVQIIDKPIAQNPLKELISWFLLNKDAFSRDNELFKGLSSKMVTLARIMAGILRDRGEGLKELQAMTSKLDNIGLLHPSFSVPVTDSLKDAAFYRAFFSELEGLLNIGRSRLIIERITLQSQQSKNKKTRRPLMPEPFINEDKEVFLAFPKFETKNKVKGTRVVYNSPDEVNWLLSPIRSSKGQLSFMFRCLSEDAKIMTTSGGCSYIVEFKKLLEAQEEVLSIHDCDIIPRAFVSIPFTLERESEETKPDWKPNRFMGVDIGEYAVAYCVIEKGTDSIEILDCGIVRNGAHRVLKEKVDRLKRRQRSMTFGAMDTSIAAARESLVGNYRNRLHAIALKHGAKLVYEYEVSAFESGGNRIKKVYETLKKSDCTGETEADKNARKHIWGETNAVGDQIGAGWTSQTCAKCGRSFGADLKAGNFGVAVPVPEKVEDSKGHYAYHEFPFEDGLKVRGFLKPNKIISDQKELAKAVHAYMRPPLVALGKRKLPKNARYRRGNSSLFRCPFSDCGFTADADIQAAYNIAVKQLYKPKKGYPKERKWQDFVILKPKEPSKLFDKQFYRPN

SEQ ID NO: 708-709 - skipped (2 entries)

SEQ ID NO: 710 - DNA, 6 bp, Artificial Sequence
  Synthetic construct
cuccga

SEQ ID NO: 711 - DNA, 6 bp, Artificial Sequence
  Synthetic construct
ctccga

SEQ ID NO: 712 - DNA, 6 bp, Artificial Sequence
  Synthetic construct
ccccga

SEQ ID NO: 713 - DNA, 5 bp, Artificial Sequence
  Synthetic construct
aagua

SEQ ID NO: 714 - DNA, 5 bp, Artificial Sequence
  Synthetic construct
aagta

SEQ ID NO: 715 - DNA, 5 bp, Artificial Sequence
  Synthetic construct
aaaaa

SEQ ID NO: 716 - DNA, 14 bp, Artificial Sequence
  Synthetic construct
ucggggauaaaggc

SEQ ID NO: 717 - DNA, 14 bp, Artificial Sequence
  Synthetic construct
tcggggataaaggc

SEQ ID NO: 718 - DNA, 14 bp, Artificial Sequence
  Synthetic construct
ucggagauaaaggc

SEQ ID NO: 719 - DNA, 14 bp, Artificial Sequence
  Synthetic construct
tcggagataaaggc

SEQ ID NO: 720 - DNA, 25 bp, Artificial Sequence
  Synthetic construct
cuccgaaaguaucggggauaaaggc

SEQ ID NO: 721 - DNA, 25 bp, Artificial Sequence
  Synthetic construct
ctccgaaagtatcggggataaaggc

SEQ ID NO: 722 - DNA, 11 bp, Artificial Sequence
  Synthetic construct
caccgaaauuu

SEQ ID NO: 723 - DNA, 11 bp, Artificial Sequence
  Synthetic construct
caccgaaattt

SEQ ID NO: 724 - DNA, 11 bp, Artificial Sequence
  Synthetic construct
caccgaaaucc

SEQ ID NO: 725 - DNA, 11 bp, Artificial Sequence
  Synthetic construct
caccgaaatcc

SEQ ID NO: 726 - DNA, 5 bp, Artificial Sequence
  Synthetic construct
ggaga

SEQ ID NO: 727 - DNA, 5 bp, Artificial Sequence
  Synthetic construct
gaaga

SEQ ID NO: 728 - DNA, 5 bp, Artificial Sequence
  Synthetic construct
aaaaa

SEQ ID NO: 729 - DNA, 9 bp, Artificial Sequence
  Synthetic construct
ggauaaggc

SEQ ID NO: 730 - DNA, 9 bp, Artificial Sequence
  Synthetic construct
ggataaggc

SEQ ID NO: 731 - DNA, 9 bp, Artificial Sequence
  Synthetic construct
aaauaaggc

SEQ ID NO: 732 - DNA, 9 bp, Artificial Sequence
  Synthetic construct
aaataaggc

SEQ ID NO: 733 - DNA, 25 bp, Artificial Sequence
  Synthetic construct
caccgaaauuuggagaggauaaggc

SEQ ID NO: 734 - DNA, 25 bp, Artificial Sequence
  Synthetic construct
caccgaaatttggagaggataaggc

SEQ ID NO: 735 - DNA, 6 bp, Artificial Sequence
  Synthetic construct
cuccga

SEQ ID NO: 736 - DNA, 6 bp, Artificial Sequence
  Synthetic construct
ctccga

SEQ ID NO: 737 - DNA, 4 bp, Artificial Sequence
  Synthetic construct
auua

SEQ ID NO: 738 - DNA, 4 bp, Artificial Sequence
  Synthetic construct
atta

SEQ ID NO: 739 - DNA, 4 bp, Artificial Sequence
  Synthetic construct
aaaa

SEQ ID NO: 740 - DNA, 15 bp, Artificial Sequence
  Synthetic construct
ucgggaggauaaggc

SEQ ID NO: 741 - DNA, 15 bp, Artificial Sequence
  Synthetic construct
tcgggaggataaggc

SEQ ID NO: 742 - DNA, 14 bp, Artificial Sequence
  Synthetic construct
ucggaggauaaggc

SEQ ID NO: 743 - DNA, 14 bp, Artificial Sequence
  Synthetic construct
tcggaggataaggc

SEQ ID NO: 744 - DNA, 25 bp, Artificial Sequence
  Synthetic construct
cuccgaauuaucgggaggauaaggc

SEQ ID NO: 745 - DNA, 25 bp, Artificial Sequence
  Synthetic construct
ctccgaattatcgggaggataaggc

SEQ ID NO: 746 - DNA, 4 bp, Artificial Sequence
  Synthetic construct
cccc

SEQ ID NO: 747 - DNA, 4 bp, Artificial Sequence
  Synthetic construct
cucc

SEQ ID NO: 748 - DNA, 4 bp, Artificial Sequence
  Synthetic construct
ctcc

SEQ ID NO: 749 - DNA, 7 bp, Artificial Sequence
  Synthetic construct
gaauaua

SEQ ID NO: 750 - DNA, 7 bp, Artificial Sequence
  Synthetic construct
gaatata

SEQ ID NO: 751 - DNA, 5 bp, Artificial Sequence
  Synthetic construct
aaaaa

SEQ ID NO: 752 - DNA, 4 bp, Artificial Sequence
  Synthetic construct
aaaa

SEQ ID NO: 753 - DNA, 14 bp, Artificial Sequence
  Synthetic construct
ggggacaaaaaggc

SEQ ID NO: 754 - DNA, 14 bp, Artificial Sequence
  Synthetic construct
gaggacaaaaaggc

SEQ ID NO: 755 - DNA, 25 bp, Artificial Sequence
  Synthetic construct
ccccgaauauaggggacaaaaaggc

SEQ ID NO: 756 - DNA, 25 bp, Artificial Sequence
  Synthetic construct
ccccgaatataggggacaaaaaggc

SEQ ID NO: 757 - DNA, 13 bp, Artificial Sequence
  Synthetic construct
gucuagacauaca

SEQ ID NO: 758 - DNA, 13 bp, Artificial Sequence
  Synthetic construct
gtctagacataca

SEQ ID NO: 759 - DNA, 13 bp, Artificial Sequence
  Synthetic construct
gucuagacauuca

SEQ ID NO: 760 - DNA, 13 bp, Artificial Sequence
  Synthetic construct
gtctagacattca

SEQ ID NO: 761 - DNA, 10 bp, Artificial Sequence
  Synthetic construct
ggtggaaagg

SEQ ID NO: 762 - DNA, 10 bp, Artificial Sequence
  Synthetic construct
gguggaaagg

SEQ ID NO: 763 - DNA, 5 bp, Artificial Sequence
  Synthetic construct
aaaaa

SEQ ID NO: 764 - DNA, 4 bp, Artificial Sequence
  Synthetic construct
aaaa

SEQ ID NO: 765 - DNA, 13 bp, Artificial Sequence
  Synthetic construct
ugagaguaaagac

SEQ ID NO: 766 - DNA, 13 bp, Artificial Sequence
  Synthetic construct
tgagagtaaagac

SEQ ID NO: 767 - DNA, 13 bp, Artificial Sequence
  Synthetic construct
ugugaguaaagac

SEQ ID NO: 768 - DNA, 13 bp, Artificial Sequence
  Synthetic construct
tgtgagtaaagac

SEQ ID NO: 769 - DNA, 36 bp, Artificial Sequence
  Synthetic construct
gucuagacauacagguggaaaggugagaguaaagac

SEQ ID NO: 770 - DNA, 36 bp, Artificial Sequence
  Synthetic construct
gtctagacatacaggtggaaaggtgagagtaaagac

SEQ ID NO: 771 - DNA, 12 bp, Artificial Sequence
  Synthetic construct
gucuagacauac

SEQ ID NO: 772 - DNA, 12 bp, Artificial Sequence
  Synthetic construct
gtctagacatac

SEQ ID NO: 773 - DNA, 12 bp, Artificial Sequence
  Synthetic construct
gucuagacauuc

SEQ ID NO: 774 - DNA, 12 bp, Artificial Sequence
  Synthetic construct
gtctagacattc

SEQ ID NO: 775 - DNA, 6 bp, Artificial Sequence
  Synthetic construct
aggtgg

SEQ ID NO: 776 - DNA, 6 bp, Artificial Sequence
  Synthetic construct
aggugg

SEQ ID NO: 777 - DNA, 5 bp, Artificial Sequence
  Synthetic construct
aaaaa

SEQ ID NO: 778 - DNA, 4 bp, Artificial Sequence
  Synthetic construct
aaaa

SEQ ID NO: 779 - DNA, 19 bp, Artificial Sequence
  Synthetic construct
gaaaggugagaguaaagac

SEQ ID NO: 780 - DNA, 19 bp, Artificial Sequence
  Synthetic construct
gaaaggtgagagtaaagac

SEQ ID NO: 781 - DNA, 18 bp, Artificial Sequence
  Synthetic construct
gaacgugagaguaaagac

SEQ ID NO: 782 - DNA, 18 bp, Artificial Sequence
  Synthetic construct
gaacgtgagagtaaagac

SEQ ID NO: 783 - DNA, 36 bp, Artificial Sequence; identical to SEQ ID NO: 769
  Synthetic construct

SEQ ID NO: 784 - DNA, 36 bp, Artificial Sequence; identical to SEQ ID NO: 770
  Synthetic construct

SEQ ID NO: 785 - DNA, 7 bp, Artificial Sequence
  Synthetic construct
cuccgug

SEQ ID NO: 786 - DNA, 7 bp, Artificial Sequence
  Synthetic construct
ctccgtg

SEQ ID NO: 787 - DNA, 7 bp, Artificial Sequence
  Synthetic construct
ccccgug

SEQ ID NO: 788 - DNA, 7 bp, Artificial Sequence
  Synthetic construct
ccccgtg

SEQ ID NO: 789 - DNA, 7 bp, Artificial Sequence
  Synthetic construct
cuccaug

SEQ ID NO: 790 - DNA, 7 bp, Artificial Sequence
  Synthetic construct
cuccatg

SEQ ID NO: 791 - DNA, 4 bp, Artificial Sequence
  Synthetic construct
aaua

SEQ ID NO: 792 - DNA, 4 bp, Artificial Sequence
  Synthetic construct
aata

SEQ ID NO: 793 - DNA, 4 bp, Artificial Sequence
  Synthetic construct
aaaa

SEQ ID NO: 794 - DNA, 5 bp, Artificial Sequence
  Synthetic construct
aaaaa

SEQ ID NO: 795 - DNA, 14 bp, Artificial Sequence
  Synthetic construct
cgugggguaaaggc

SEQ ID NO: 796 - DNA, 14 bp, Artificial Sequence
  Synthetic construct
cgtggggtaaaggc

SEQ ID NO: 797 - DNA, 14 bp, Artificial Sequence
  Synthetic construct
caugggguaaaggc

SEQ ID NO: 798 - DNA, 14 bp, Artificial Sequence
  Synthetic construct
catggggtaaaggc

SEQ ID NO: 799 - DNA, 25 bp, Artificial Sequence
  Synthetic construct
cuccgugaauacgugggguaaaggc

SEQ ID NO: 800 - DNA, 25 bp, Artificial Sequence
  Synthetic construct
ctccgtgaatacgtggggtaaaggc

SEQ ID NO: 801 - DNA, 27 bp, Artificial Sequence
  Synthetic construct
  misc_feature (26)..(26): n can be any targeting portion (V) described herein
  misc_feature (27)..(27): n can be any third portion (D) described herein
cuccgaaaguaucggggauaaaggcnn

SEQ ID NO: 802 - DNA, 27 bp, Artificial Sequence
  Synthetic construct
  misc_feature (26)..(26): n can be any targeting portion (V) described herein
  misc_feature (27)..(27): n can be any third portion (D) described herein
ctccgaaagtatcggggataaaggcnn

SEQ ID NO: 803 - DNA, 27 bp, Artificial Sequence
  Synthetic construct
  misc_feature (26)..(26): n can be any targeting portion (V) described herein
  misc_feature (27)..(27): n can be any third portion (D) described herein
caccgaaauuuggagaggauaaggcnn

SEQ ID NO: 804 - DNA, 27 bp, Artificial Sequence
  Synthetic construct
  misc_feature (26)..(26): n can be any targeting portion (V) described herein
  misc_feature (27)..(27): n can be any third portion (D) described herein
caccgaaatttggagaggataaggcnn

SEQ ID NO: 805 - DNA, 27 bp, Artificial Sequence
  Synthetic construct
  misc_feature (26)..(26): n can be any targeting portion (V) described herein
  misc_feature (27)..(27): n can be any third portion (D) described herein
cuccgaauuaucgggaggauaaggcnn

SEQ ID NO: 806 - DNA, 27 bp, Artificial Sequence
  Synthetic construct
  misc_feature (26)..(26): n can be any targeting portion (V) described herein
  misc_feature (27)..(27): n can be any third portion (D) described herein
ctccgaattatcgggaggataaggcnn

SEQ ID NO: 807 - DNA, 27 bp, Artificial Sequence
  Synthetic construct
  misc_feature (26)..(26): n can be any targeting portion (V) described herein
  misc_feature (27)..(27): n can be any third portion (D) described herein
ccccgaauauaggggacaaaaaggcnn

SEQ ID NO: 808 - DNA, 27 bp, Artificial Sequence
  Synthetic construct
  misc_feature (26)..(26): n can be any targeting portion (V) described herein
  misc_feature (27)..(27): n can be any third portion (D) described herein
ccccgaatataggggacaaaaaggcnn

SEQ ID NO: 809 - DNA, 38 bp, Artificial Sequence
  Synthetic construct
  misc_feature (37)..(37): n can be any targeting portion (V) described herein
  misc_feature (38)..(38): n can be any third portion (D) described herein
gucuagacauacagguggaaaggugagaguaaagacnn

SEQ ID NO: 810 - DNA, 38 bp, Artificial Sequence
  Synthetic construct
  misc_feature (37)..(37): n can be any targeting portion (V) described herein
  misc_feature (38)..(38): n can be any third portion (D) described herein
gtctagacatacaggtggaaaggtgagagtaaagacnn

SEQ ID NO: 811 - DNA, 38 bp, Artificial Sequence; identical to SEQ ID NO: 809
  Synthetic construct
  misc_feature (37)..(37): n can be any targeting portion (V) described herein
  misc_feature (38)..(38): n can be any third portion (D) described herein

SEQ ID NO: 812 - DNA, 38 bp, Artificial Sequence; identical to SEQ ID NO: 810
  Synthetic construct
  misc_feature (37)..(37): n can be any targeting portion (V) described herein
  misc_feature (38)..(38): n can be any third portion (D) described herein

SEQ ID NO: 813 - DNA, 27 bp, Artificial Sequence
  Synthetic construct
  misc_feature (26)..(26): n can be any targeting portion (V) described herein
  misc_feature (27)..(27): n can be any third portion (D) described herein
cuccgugaauacgugggguaaaggcnn

SEQ ID NO: 814 - DNA, 27 bp, Artificial Sequence
  Synthetic construct
  misc_feature (26)..(26): n can be any targeting portion (V) described herein
  misc_feature (27)..(27): n can be any third portion (D) described herein
ctccgtgaatacgtggggtaaaggcnn

SEQ ID NO: 815-819 - skipped (5 entries)

SEQ ID NO: 820 - protein, 986 aa, Deltaproteobacteria
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 821 - protein, 978 aa, Planctomycetes
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 822 - protein, 855 aa, Candidatus Sungbacteria
MDNANKPSTKSLVNTTRISDHFGVTPGQVTRVFSFGIIPTKRQYAIIERWFAAVEAARERLYGMLYAHFQENPPAYLKEKFSYETFFKGRPVLNGLRDIDPTIMTSAVFTALRHKAEGAMAAFHTNHRRLFEEARKKMREYAECLKANEALLRGAADIDWDKIVNALRTRLNTCLAPEYDAVIADFGALCAFRALIAETNALKGAYNHALNQMLPALVKVDEPEEAEESPRLRFFNGRINDLPKFPVAERETPPDTETIIRQLEDMARVIPDTAEILGYIHRIRHKAARRKPGSAVPLPQRVALYCAIRMERNPEEDPSTVAGHFLGEIDRVCEKRRQGLVRTPFDSQIRARYMDIISFRATLAHPDRWTEIQFLRSNAASRRVRAETISAPFEGFSWTSNRTNPAPQYGMALAKDANAPADAPELCICLSPSSAAFSVREKGGDLIYMRPTGGRRGKDNPGKEITWVPGSFDEYPASGVALKLRLYFGRSQARRMLTNKTWGLLSDNPRVFAANAELVGKKRNPQDRWKLFFHMVISGPPPVEYLDFSSDVRSRARTVIGINRGEVNPLAYAVVSVEDGQVLEEGLLGKKEYIDQLIETRRRISEYQSREQTPPRDLRQRVRHLQDTVLGSARAKIHSLIAFWKGILAIERLDDQFHGREQKIIPKKTYLANKTGFMNALSFSGAVRVDKKGNPWGGMIEIYPGGISRTCTQCGTVWLARRPKNPGHRDAMVVIPDIVDDAAATGFDNVDCDAGTVDYGELFTLSREWVRLTPRYSRVMRGTLGDLERAIRQGDDRKSRQMLELALEPQPQWGQFFCHRCGFNGQSDVLAATNLARRAISLIRRLPDTDTPPTP

SEQ ID NO: 823-824 - skipped (2 entries)

SEQ ID NO: 825 - DNA, 72 bp, Artificial Sequence
  Synthetic construct
ggcgcgtttattccattactttggagccagtcccagcgactatgtcgtatggacgaagcgcttatttatcgg

SEQ ID NO: 826 - DNA, 72 bp, Artificial Sequence
  Synthetic construct
ggcgcguuuauuccauuacuuuggagccagucccagcgacuaugucguauggacgaagcgcuuauuuaucgg

SEQ ID NO: 827 - DNA, 47 bp, Artificial Sequence
  Synthetic construct
gccagucccagcgacuaugucguauggacgaagcgcuuauuuaucgg

SEQ ID NO: 828 - DNA, 47 bp, Artificial Sequence
  Synthetic construct
gccagtcccagcgactatgtcgtatggacgaagcgcttatttatcgg

SEQ ID NO: 829 - DNA, 81 bp, Artificial Sequence
  Synthetic construct
auuacaucuggcgcguuuauuccauuacuuuggagccagucccagcgacuaugucguauggacgaagcgcuuauuuaucgg

SEQ ID NO: 830 - DNA, 81 bp, Artificial Sequence
  Synthetic construct
attacatctggcgcgtttattccattactttggagccagtcccagcgactatgtcgtatggacgaagcgcttatttatcgg

SEQ ID NO: 831 - DNA, 81 bp, Artificial Sequence
  Synthetic construct
acaucuggcgcguuuauuccauuacuuuggagccagucccagcgacuaugucguauggacgaagcgcuuauuuaucggaga

SEQ ID NO: 832 - DNA, 81 bp, Artificial Sequence
  Synthetic construct
acatctggcgcgtttattccattactttggagccagtcccagcgactatgtcgtatggacgaagcgcttatttatcggaga

SEQ ID NO: 833 - DNA, 78 bp, Artificial Sequence
  Synthetic construct
acaucuggcgcguuuauuccauuacuuuggagccagucccagcgacuaugucguauggacgaagcgcuuauuuaucgg

SEQ ID NO: 834 - DNA, 78 bp, Artificial Sequence
  Synthetic construct
acatctggcgcgtttattccattactttggagccagtcccagcgactatgtcgtatggacgaagcgcttatttatcgg

SEQ ID NO: 835 - DNA, 93 bp, Artificial Sequence
  Synthetic construct
aaguaguaaauuacaucuggcgcguuuauuccauuacuuuggagccagucccagcgacuaugucguauggacgaagcgcuuauuuaucggaga

SEQ ID NO: 836 - DNA, 93 bp, Artificial Sequence
  Synthetic construct
aagtagtaaattacatctggcgcgtttattccattactttggagccagtcccagcgactatgtcgtatggacgaagcgcttatttatcggaga

SEQ ID NO: 837 - DNA, 65 bp, Artificial Sequence
  Synthetic construct
uuauuccauuacuuuggagccagucccagcgacuaugucguauggacgaagcgcuuauuuaucgg

SEQ ID NO: 838 - DNA, 65 bp, Artificial Sequence
  Synthetic construct
ttattccattactttggagccagtcccagcgactatgtcgtatggacgaagcgcttatttatcgg

SEQ ID NO: 839 - DNA, 67 bp, Artificial Sequence
  Synthetic construct
uuauuccauuacuuuggagccagucccagcgacuaugucguauggacgaagcgcuuauuuaucggag

SEQ ID NO: 840 - DNA, 67 bp, Artificial Sequence
  Synthetic construct
ttattccattactttggagccagtcccagcgactatgtcgtatggacgaagcgcttatttatcggag

SEQ ID NO: 841 - DNA, 7 bp, Artificial Sequence
  Synthetic construct
agagaaa

SEQ ID NO: 842 - DNA, 6 bp, Artificial Sequence
  Synthetic construct
gagaaa

SEQ ID NO: 843 - DNA, 4 bp, Artificial Sequence
  Synthetic construct
gaaa

SEQ ID NO: 844 - DNA, 4 bp, Artificial Sequence
  Synthetic construct
aaaa

SEQ ID NO: 845 - DNA, 24 bp, Artificial Sequence
  Synthetic construct
ccgauaaguaaaacgcaucaaagu

SEQ ID NO: 846 - DNA, 24 bp, Artificial Sequence
  Synthetic construct
ccgataagtaaaacgcatcaaagt

SEQ ID NO: 847 - DNA, 43 bp, Artificial Sequence
  Synthetic construct
ccgauaaguaaaacgcaucaaaguauuaaauacucguauugcu

SEQ ID NO: 848 - DNA, 43 bp, Artificial Sequence
  Synthetic construct
ccgataagtaaaacgcatcaaagtattaaatactcgtattgct

SEQ ID NO: 849 - DNA, 37 bp, Artificial Sequence
  Synthetic construct
auuugaagguaucuccgauaaguaaaacgcaucaaag

SEQ ID NO: 850 - DNA, 37 bp, Artificial Sequence
  Synthetic construct
atttgaaggtatctccgataagtaaaacgcatcaaag

SEQ ID NO: 851 - DNA, 23 bp, Artificial Sequence
  Synthetic construct
ccgauaaguaaaacgcaucaaag

SEQ ID NO: 852 - DNA, 23 bp, Artificial Sequence
  Synthetic construct
ccgataagtaaaacgcatcaaag

SEQ ID NO: 853 - DNA, 66 bp, Artificial Sequence
  Synthetic construct
uuaucucauuacuuugagagccaucaccagcgacuaugucguauggguaaagcgcuuauuuaucgg

SEQ ID NO: 854 - DNA, 66 bp, Artificial Sequence
  Synthetic construct
ttatctcattactttgagagccatcaccagcgactatgtcgtatgggtaaagcgcttatttatcgg

SEQ ID NO: 855 - DNA, 69 bp, Artificial Sequence
  Synthetic construct
uuaucucauuacuuugagagccaucaccagcgacuaugucguauggguaaagcgcuuauuuaucggaga

SEQ ID NO: 856 - DNA, 69 bp, Artificial Sequence
  Synthetic construct
ttatctcattactttgagagccatcaccagcgactatgtcgtatgggtaaagcgcttatttatcggaga

SEQ ID NO: 857 - DNA, 7 bp, Artificial Sequence
  Synthetic construct
agagaaa

SEQ ID NO: 858 - DNA, 6 bp, Artificial Sequence
  Synthetic construct
gagaaa

SEQ ID NO: 859 - DNA, 4 bp, Artificial Sequence
  Synthetic construct
gaaa

SEQ ID NO: 860 - DNA, 4 bp, Artificial Sequence
  Synthetic construct
aaaa

SEQ ID NO: 861 - DNA, 26 bp, Artificial Sequence
  Synthetic construct
ucuccgauaaauaagaagcaucaaag

SEQ ID NO: 862 - DNA, 26 bp, Artificial Sequence
  Synthetic construct
tctccgataaataagaagcatcaaag

SEQ ID NO: 863 - DNA, 230 bp, Artificial Sequence
  Synthetic construct
uaaauuuuuugagcccuaucuccgcgaggaagacagggcucuuuucaugagaggaagcuuuuauacccgaccgguaauccggucgggggauuggccguugaaacgauuuuaaagcggccaaugggccccucuauauggauacuacuuauauaaggagcuuggggaagaagauagcuuaaucccgcuaucuugucaagggguugggggaguaucaguauccggcaggcgcc

SEQ ID NO: 864 - DNA, 230 bp, Artificial Sequence
  Synthetic construct
taaattttttgagccctatctccgcgaggaagacagggctcttttcatgagaggaagcttttatacccgaccggtaatccggtcgggggattggccgttgaaacgattttaaagcggccaatgggcccctctatatggatactacttatataaggagcttggggaagaagatagcttaatcccgctatcttgtcaaggggttgggggagtatcagtatccggcaggcgcc

SEQ ID NO: 865 - DNA, 60 bp, Artificial Sequence
  Synthetic construct
ucaugagaggaagcuuuuauacccgaccgguaauccggucgggggauuggccguugaaac

SEQ ID NO: 866 - DNA, 60 bp, Artificial Sequence
  Synthetic construct
tcatgagaggaagcttttatacccgaccggtaatccggtcgggggattggccgttgaaac

SEQ ID NO: 867 - DNA, 7 bp, Artificial Sequence
  Synthetic construct
agagaaa

SEQ ID NO: 868 - DNA, 6 bp, Artificial Sequence
  Synthetic construct
gagaaa

SEQ ID NO: 869 - DNA, 4 bp, Artificial Sequence
  Synthetic construct
gaaa

SEQ ID NO: 870 - DNA, 4 bp, Artificial Sequence
  Synthetic construct
aaaa

SEQ ID NO: 871 - DNA, 25 bp, Artificial Sequence
  Synthetic construct
guuuacacacucccucucauagggu

SEQ ID NO: 872 - DNA, 25 bp, Artificial Sequence
  Synthetic construct
gtttacacactccctctcatagggt

SEQ ID NO: 873 - DNA, 25 bp, Artificial Sequence
  Synthetic construct
guuuacacacucccucucaugaggu

SEQ ID NO: 874 - DNA, 25 bp, Artificial Sequence
  Synthetic construct
gtttacacactccctctcatgaggt

SEQ ID NO: 875 - DNA, 25 bp, Artificial Sequence
  Synthetic construct
uuuuacauacccccucucaugggau

SEQ ID NO: 876 - DNA, 25 bp, Artificial Sequence
  Synthetic construct
ttttacataccccctctcatgggat

SEQ ID NO: 877 - DNA, 25 bp, Artificial Sequence
  Synthetic construct
guuuacacacucccucucauggggg

SEQ ID NO: 878 - DNA, 25 bp, Artificial Sequence
  Synthetic construct
gtttacacactccctctcatggggg

SEQ ID NO: 879 - DNA, 105 bp, Artificial Sequence
  Synthetic construct
  misc_feature (104)..(104): n can be any targeting portion (V) described herein
  misc_feature (105)..(105): n can be any third portion (D) described herein
ggcgcguuuauuccauuacuuuggagccagucccagcgacuaugucguauggacgaagcgcuuauuuaucggagagaaaccgauaaguaaaacgcaucaaagunn

SEQ ID NO: 880 - DNA, 105 bp, Artificial Sequence
  Synthetic construct
  misc_feature (104)..(104): n can be any targeting portion (V) described herein
  misc_feature (105)..(105): n can be any third portion (D) described herein
ggcgcgtttattccattactttggagccagtcccagcgactatgtcgtatggacgaagcgcttatttatcggagagaaaccgataagtaaaacgcatcaaagtnn

SEQ ID NO: 881 - DNA, 99 bp, Artificial Sequence
  Synthetic construct
  misc_feature (98)..(98): n can be any targeting portion (V) described herein
  misc_feature (99)..(99): n can be any third portion (D) described herein
gccagucccagcgacuaugucguauggacgaagcgcuuauuuaucggagagaaaccgauaaguaaaacgcaucaaaguauuaaauacucguauugcunn

SEQ ID NO: 882 - DNA, 99 bp, Artificial Sequence
  Synthetic construct
  misc_feature (98)..(98): n can be any targeting portion (V) described herein
  misc_feature (99)..(99): n can be any third portion (D) described herein
gccagtcccagcgactatgtcgtatggacgaagcgcttatttatcggagagaaaccgataagtaaaacgcatcaaagtattaaatactcgtattgctnn

SEQ ID NO: 883 - DNA, 133 bp, Artificial Sequence
  Synthetic construct
  misc_feature (132)..(132): n can be any targeting portion (V) described herein
  misc_feature (133)..(133): n can be any third portion (D) described herein
auuacaucuggcgcguuuauuccauuacuuuggagccagucccagcgacuaugucguauggacgaagcgcuuauuuaucggagagaaaccgauaaguaaaacgcaucaaaguauuaaauacucguauugcunn

SEQ ID NO: 884 - DNA, 133 bp, Artificial Sequence
  Synthetic construct
  misc_feature (132)..(132): n can be any targeting portion (V) described herein
  misc_feature (133)..(133): n can be any third portion (D) described herein
attacatctggcgcgtttattccattactttggagccagtcccagcgactatgtcgtatggacgaagcgcttatttatcggagagaaaccgataagtaaaacgcatcaaagtattaaatactcgtattgctnn

SEQ ID NO: 885 - DNA, 94 bp, Artificial Sequence
  Synthetic construct
  misc_feature (93)..(93): n can be any targeting portion (V) described herein
  misc_feature (94)..(94): n can be any third portion (D) described herein
uuauuccauuacuuuggagccagucccagcgacuaugucguauggacgaagcgcuuauuuaucgggaaaccgauaaguaaaacgcaucaaagnn

SEQ ID NO: 886 - DNA, 94 bp, Artificial Sequence
  Synthetic construct
  misc_feature (93)..(93): n can be any targeting portion (V) described herein
  misc_feature (94)..(94): n can be any third portion (D) described herein
ttattccattactttggagccagtcccagcgactatgtcgtatggacgaagcgcttatttatcgggaaaccgataagtaaaacgcatcaaagnn

SEQ ID NO: 887 - DNA, 97 bp, Artificial Sequence
  Synthetic construct
  misc_feature (96)..(96): n can be any targeting portion (V) described herein
  misc_feature (97)..(97): n can be any third portion (D) described herein
uuauuccauuacuuuggagccagucccagcgacuaugucguauggacgaagcgcuuauuuaucggagagaaaccgauaaguaaaacgcaucaaagnn

SEQ ID NO: 888 - DNA, 97 bp, Artificial Sequence
  Synthetic construct
  misc_feature (96)..(96): n can be any targeting portion (V) described herein
  misc_feature (97)..(97): n can be any third portion (D) described herein
ttattccattactttggagccagtcccagcgactatgtcgtatggacgaagcgcttatttatcggagagaaaccgataagtaaaacgcatcaaagnn

SEQ ID NO: 889 - DNA, 110 bp, Artificial Sequence
  Synthetic construct
  misc_feature (109)..(109): n can be any targeting portion (V) described herein
  misc_feature (110)..(110): n can be any third portion (D) described herein
acaucuggcgcguuuauuccauuacuuuggagccagucccagcgacuaugucguauggacgaagcgcuuauuuaucggagagaaaccgauaaguaaaacgcaucaaagnn

SEQ ID NO: 890 - DNA, 110 bp, Artificial Sequence
  Synthetic construct
  misc_feature (109)..(109): n can be any targeting portion (V) described herein
  misc_feature (110)..(110): n can be any third portion (D) described herein
acatctggcgcgtttattccattactttggagccagtcccagcgactatgtcgtatggacgaagcgcttatttatcggagagaaaccgataagtaaaacgcatcaaagnn

SEQ ID NO: 891 - DNA, 107 bp, Artificial Sequence
  Synthetic construct
  misc_feature (106)..(106): n can be any targeting portion (V) described herein
  misc_feature (107)..(107): n can be any third portion (D) described herein
acaucuggcgcguuuauuccauuacuuuggagccagucccagcgacuaugucguauggacgaagcgcuuauuuaucgggaaaccgauaaguaaaacgcaucaaagnn

SEQ ID NO: 892 - DNA, 107 bp, Artificial Sequence
  Synthetic construct
  misc_feature (106)..(106): n can be any targeting portion (V) described herein
  misc_feature (107)..(107): n can be any third portion (D) described herein
acatctggcgcgtttattccattactttggagccagtcccagcgactatgtcgtatggacgaagcgcttatttatcgggaaaccgataagtaaaacgcatcaaagnn

SEQ ID NO: 893 - DNA, 98 bp, Artificial Sequence
  Synthetic construct
  misc_feature (97)..(97): n can be any targeting portion (V) described herein
  misc_feature (98)..(98): n can be any third portion (D) described herein
uuaucucauuacuuugagagccaucaccagcgacuaugucguauggguaaagcgcuuauuuaucgggaaaucuccgauaaauaagaagcaucaaagnn

SEQ ID NO: 894 - DNA, 98 bp, Artificial Sequence
  Synthetic construct
  misc_feature (97)..(97): n can be any targeting portion (V) described herein
  misc_feature (98)..(98): n can be any third portion (D) described herein
ttatctcattactttgagagccatcaccagcgactatgtcgtatgggtaaagcgcttatttatcgggaaatctccgataaataagaagcatcaaagnn

SEQ ID NO: 895 - DNA, 101 bp, Artificial Sequence
  Synthetic construct
  misc_feature (100)..(100): n can be any targeting portion (V) described herein
  misc_feature (101)..(101): n can be any third portion (D) described herein
uuaucucauuacuuugagagccaucaccagcgacuaugucguauggguaaagcgcuuauuuaucggagagaaaucuccgauaaauaagaagcaucaaagnn

SEQ ID NO: 896 - DNA, 101 bp, Artificial Sequence
  Synthetic construct
  misc_feature (100)..(100): n can be any targeting portion (V) described herein
  misc_feature (101)..(101): n can be any third portion (D) described herein
ttatctcattactttgagagccatcaccagcgactatgtcgtatgggtaaagcgcttatttatcggagagaaatctccgataaataagaagcatcaaagnn

SEQ ID NO: 897 - DNA, 261 bp, Artificial Sequence
  Synthetic construct
  misc_feature (260)..(260): n can be any targeting portion (V) described herein
  misc_feature (261)..(261): n can be any third portion (D) described herein
uaaauuuuuugagcccuaucuccgcgaggaagacagggcucuuuucaugagaggaagcuuuuauacccgaccgguaauccggucgggggauuggccguugaaacgauuuuaaagcggccaaugggccccucuauauggauacuacuuauauaaggagcuuggggaagaagauagcuuaaucccgcuaucuugucaagggguugggggaguaucaguauccggcaggcgccgaaaguuuacacacucccucucauagggunn

SEQ ID NO: 898 - DNA, 261 bp, Artificial Sequence
  Synthetic construct
  misc_feature (260)..(260): n can be any targeting portion (V) described herein
  misc_feature (261)..(261): n can be any third portion (D) described herein
taaattttttgagccctatctccgcgaggaagacagggctcttttcatgagaggaagcttttatacccgaccggtaatccggtcgggggattggccgttgaaacgattttaaagcggccaatgggcccctctatatggatactacttatataaggagcttggggaagaagatagcttaatcccgctatcttgtcaaggggttgggggagtatcagtatccggcaggcgccgaaagtttacacactccctctcatagggtnn

SEQ ID NO: 899 - DNA, 261 bp, Artificial Sequence
  Synthetic construct
  misc_feature (260)..(260): n can be any targeting portion (V) described herein
  misc_feature (261)..(261): n can be any third portion (D) described herein
uaaauuuuuugagcccuaucuccgcgaggaagacagggcucuuuucaugagaggaagcuuuuauacccgaccgguaauccggucgggggauuggccguugaaacgauuuuaaagcggccaaugggccccucuauauggauacuacuuauauaaggagcuuggggaagaagauagcuuaaucccgcuaucuugucaagggguugggggaguaucaguauccggcaggcgccgaaaguuuacacacucccucucaugaggunn

SEQ ID NO: 900 - DNA, 261 bp, Artificial Sequence
  Synthetic construct
  misc_feature (260)..(260): n can be any targeting portion (V) described herein
  misc_feature (261)..(261): n can be any third portion (D) described herein
taaattttttgagccctatctccgcgaggaagacagggctcttttcatgagaggaagcttttatacccgaccggtaatccggtcgggggattggccgttgaaacgattttaaagcggccaatgggcccctctatatggatactacttatataaggagcttggggaagaagatagcttaatcccgctatcttgtcaaggggttgggggagtatcagtatccggcaggcgccgaaagtttacacactccctctcatgaggtnn

SEQ ID NO: 901 - DNA, 91 bp, Artificial Sequence
  Synthetic construct
  misc_feature (90)..(90): n can be any targeting portion (V) described herein
  misc_feature (91)..(91): n can be any third portion (D) described herein
ucaugagaggaagcuuuuauacccgaccgguaauccggucgggggauuggccguugaaacgaaaguuuacacacucccucucauagggunn

SEQ ID NO: 902 - DNA, 91 bp, Artificial Sequence
  Synthetic construct
  misc_feature (90)..(90): n can be any targeting portion (V) described herein
  misc_feature (91)..(91): n can be any third portion (D) described herein
tcatgagaggaagcttttatacccgaccggtaatccggtcgggggattggccgttgaaacgaaagtttacacactccctctcatagggtnn

SEQ ID NO: 903-909 - skipped (7 entries)

SEQ ID NO: 910 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 911 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 912 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 913 - protein, 1159 aa, Leptotrichia bucallis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 914 - skipped

SEQ ID NO: 915 - DNA, 7 bp, Artificial Sequence
  Synthetic construct
ccacccc

SEQ ID NO: 916 - DNA, 6 bp, Artificial Sequence
  Synthetic construct
cacccc

SEQ ID NO: 917 - DNA, 16 bp, Artificial Sequence
  Synthetic construct
ggauauagaccacccc

SEQ ID NO: 918 - DNA, 16 bp, Artificial Sequence
  Synthetic construct
ggatatagaccacccc

SEQ ID NO: 919 - DNA, 9 bp, Artificial Sequence
  Synthetic construct
aataucgaa

SEQ ID NO: 920 - DNA, 9 bp, Artificial Sequence
  Synthetic construct
aatatcgaa

SEQ ID NO: 921 - DNA, 4 bp, Artificial Sequence
  Synthetic construct
agaa

SEQ ID NO: 922 - DNA, 4 bp, Artificial Sequence
  Synthetic construct
aaaa

SEQ ID NO: 923 - DNA, 12 bp, Artificial Sequence
  Synthetic construct
ggggacuaaaac

SEQ ID NO: 924 - DNA, 12 bp, Artificial Sequence
  Synthetic construct
ggggactaaaac

SEQ ID NO: 925 - DNA, 5 bp, Artificial Sequence
  Synthetic construct
gggga

SEQ ID NO: 926 - DNA, 28 bp, Artificial Sequence
  Synthetic construct
ccaccccaauaucgaaggggacuaaaac

SEQ ID NO: 927 - DNA, 28 bp, Artificial Sequence
  Synthetic construct
ccaccccaatatcgaaggggactaaaac

SEQ ID NO: 928 - DNA, 20 bp, Artificial Sequence
  Synthetic construct
caccccaauaucgaagggga

SEQ ID NO: 929 - DNA, 20 bp, Artificial Sequence
  Synthetic construct
caccccaatatcgaagggga

SEQ ID NO: 930 - DNA, 30 bp, Artificial Sequence
  Synthetic construct
ggauauagaccaccccaauaucgaagggga

SEQ ID NO: 931 - DNA, 30 bp, Artificial Sequence
  Synthetic construct
ggatatagaccaccccaatatcgaagggga

SEQ ID NO: 932 - DNA, 15 bp, Artificial Sequence
  Synthetic construct
gauuuagacuacccc

SEQ ID NO: 933 - DNA, 15 bp, Artificial Sequence
  Synthetic construct
gatttagactacccc

SEQ ID NO: 934 - DNA, 13 bp, Artificial Sequence
  Synthetic construct
gauuuagaacccc

SEQ ID NO: 935 - DNA, 13 bp, Artificial Sequence
  Synthetic construct
gatttagaacccc

SEQ ID NO: 936 - DNA, 6 bp, Artificial Sequence
  Synthetic construct
cacccc

SEQ ID NO: 937 - DNA, 9 bp, Artificial Sequence
  Synthetic construct
aaaaacgaa

SEQ ID NO: 938 - DNA, 4 bp, Artificial Sequence
  Synthetic construct
agaa

SEQ ID NO: 939 - DNA, 4 bp, Artificial Sequence
  Synthetic construct
aaaa

SEQ ID NO: 940 - DNA, 12 bp, Artificial Sequence
  Synthetic construct
ggggactaaaac

SEQ ID NO: 941 - DNA, 12 bp, Artificial Sequence
  Synthetic construct
ggggacuaaaac

SEQ ID NO: 942 - DNA, 5 bp, Artificial Sequence
  Synthetic construct
gggga

SEQ ID NO: 943 - DNA, 36 bp, Artificial Sequence
  Synthetic construct
gauuuagacuaccccaaaaacgaaggggacuaaaac

SEQ ID NO: 944 - DNA, 36 bp, Artificial Sequence
  Synthetic construct
gatttagactaccccaaaaacgaaggggactaaaac

SEQ ID NO: 945 - DNA, 34 bp, Artificial Sequence
  Synthetic construct
gauuuagaaccccaaaaacgaaggggacuaaaac

SEQ ID NO: 946 - DNA, 34 bp, Artificial Sequence
  Synthetic construct
gatttagaaccccaaaaacgaaggggactaaaac

SEQ ID NO: 947 - DNA, 17 bp, Artificial Sequence
  Synthetic construct
gguaagagacuaccucu

SEQ ID NO: 948 - DNA, 17 bp, Artificial Sequence
  Synthetic construct
ggtaagagactacctct

SEQ ID NO: 949 - DNA, 16 bp, Artificial Sequence
  Synthetic construct
guaagagacuaccucu

SEQ ID NO: 950 - DNA, 16 bp, Artificial Sequence
  Synthetic construct
gtaagagactacctct

SEQ ID NO: 951 - DNA, 10 bp, Artificial Sequence
  Synthetic construct
gacuaccucu

SEQ ID NO: 952 - DNA, 10 bp, Artificial Sequence
  Synthetic construct
gactacctct

SEQ ID NO: 953 - DNA, 9 bp, Artificial Sequence
  Synthetic construct
acuaccucu

SEQ ID NO: 954 - DNA, 9 bp, Artificial Sequence
  Synthetic construct
actacctct

SEQ ID NO: 955 - DNA, 8 bp, Artificial Sequence
  Synthetic construct
auaugaaa

SEQ ID NO: 956 - DNA, 8 bp, Artificial Sequence
  Synthetic construct
atatgaaa

SEQ ID NO: 957 - DNA, 4 bp, Artificial Sequence
  Synthetic construct
aaaa

SEQ ID NO: 958 - DNA, 12 bp, Artificial Sequence
  Synthetic construct
gaggacuaaaac

SEQ ID NO: 959 - DNA, 12 bp, Artificial Sequence
  Synthetic construct
gaggactaaaac

SEQ ID NO: 960 - DNA, 6 bp, Artificial Sequence
  Synthetic construct
agagga

SEQ ID NO: 961 - DNA, 36 bp, Artificial Sequence
  Synthetic construct
guaagagacuaccucuauaugaaagaggacuaaaac

SEQ ID NO: 962 - DNA, 36 bp, Artificial Sequence
  Synthetic construct
gtaagagactacctctatatgaaagaggactaaaac

SEQ ID NO: 963 - DNA, 29 bp, Artificial Sequence
  Synthetic construct
acuaccucuauaugaaagaggacuaaaac

SEQ ID NO: 964 - DNA, 29 bp, Artificial Sequence
  Synthetic construct
actacctctatatgaaagaggactaaaac

SEQ ID NO: 965 - DNA, 23 bp, Artificial Sequence
  Synthetic construct
gacuaccucuauaugaaagagga

SEQ ID NO: 966 - DNA, 23 bp, Artificial Sequence
  Synthetic construct
gactacctctatatgaaagagga

SEQ ID NO: 967 - DNA, 30 bp, Artificial Sequence
  Synthetic construct
gguaagagacuaccucuauaugaaagagga

SEQ ID NO: 968 - DNA, 30 bp, Artificial Sequence
  Synthetic construct
ggtaagagactacctctatatgaaagagga

SEQ ID NO: 969 - DNA, 16 bp, Artificial Sequence
  Synthetic construct
ggauuuagaccacccc

SEQ ID NO: 970 - DNA, 16 bp, Artificial Sequence
  Synthetic construct
ggatttagaccacccc

SEQ ID NO: 971 - DNA, 9 bp, Artificial Sequence
  Synthetic construct
gaccacccc

SEQ ID NO: 972 - DNA, 9 bp, Artificial Sequence
  Synthetic construct
aaaaaugaa

SEQ ID NO: 973 - DNA, 9 bp, Artificial Sequence
  Synthetic construct
aaaaatgaa

SEQ ID NO: 974 - DNA, 4 bp, Artificial Sequence
  Synthetic construct
aaaa

SEQ ID NO: 975 - DNA, 6 bp, Artificial Sequence
  Synthetic construct
ugggga

SEQ ID NO: 976 - DNA, 6 bp, Artificial Sequence
  Synthetic construct
tgggga

SEQ ID NO: 977 - DNA, 5 bp, Artificial Sequence
  Synthetic construct
gggga

SEQ ID NO: 978 - DNA, 30 bp, Artificial Sequence
  Synthetic construct
ggauuuagaccaccccaaaaaugaagggga

SEQ ID NO: 979 - DNA, 30 bp, Artificial Sequence
  Synthetic construct
ggatttagaccaccccaaaaatgaagggga

SEQ ID NO: 980 - DNA, 23 bp, Artificial Sequence
  Synthetic construct
gaccaccccaaaaaugaagggga

SEQ ID NO: 981 - DNA, 23 bp, Artificial Sequence
  Synthetic construct
gaccaccccaaaaatgaagggga

SEQ ID NO: 982 - DNA, 30 bp, Artificial Sequence
  Synthetic construct
  misc_feature (29)..(29): n can be any targeting portion (V) described herein
  misc_feature (30)..(30): n can be any third portion (D) described herein
ccaccccaauaucgaaggggacuaaaacnn

SEQ ID NO: 983 - DNA, 30 bp, Artificial Sequence
  Synthetic construct
  misc_feature (29)..(29): n can be any targeting portion (V) described herein
  misc_feature (30)..(30): n can be any third portion (D) described herein
ccaccccaatatcgaaggggactaaaacnn

SEQ ID NO: 984 - DNA, 22 bp, Artificial Sequence
  Synthetic construct
  misc_feature (21)..(21): n can be any targeting portion (V) described herein
  misc_feature (22)..(22): n can be any third portion (D) described herein
caccccaauaucgaaggggann

SEQ ID NO: 985 - DNA, 22 bp, Artificial Sequence
  Synthetic construct
  misc_feature (21)..(21): n can be any targeting portion (V) described herein
  misc_feature (22)..(22): n can be any third portion (D) described herein
caccccaatatcgaaggggann

SEQ ID NO: 986 - DNA, 32 bp, Artificial Sequence
  Synthetic construct
  misc_feature (31)..(31): n can be any targeting portion (V) described herein
  misc_feature (32)..(32): n can be any third portion (D) described herein
ggauauagaccaccccaauaucgaaggggann

SEQ ID NO: 987 - DNA, 32 bp, Artificial Sequence
  Synthetic construct
  misc_feature (31)..(31): n can be any targeting portion (V) described herein
  misc_feature (32)..(32): n can be any third portion (D) described herein
ggatatagaccaccccaatatcgaaggggann

SEQ ID NO: 988 - DNA, 38 bp, Artificial Sequence
  Synthetic construct
  misc_feature (37)..(37): n can be any targeting portion (V) described herein
  misc_feature (38)..(38): n can be any third portion (D) described herein
gauuuagacuaccccaaaaacgaaggggacuaaaacnn

SEQ ID NO: 989 - DNA, 38 bp, Artificial Sequence
  Synthetic construct
  misc_feature (37)..(37): n can be any targeting portion (V) described herein
  misc_feature (38)..(38): n can be any third portion (D) described herein
gatttagactaccccaaaaacgaaggggactaaaacnn

SEQ ID NO: 990 - DNA, 36 bp, Artificial Sequence
  Synthetic construct
  misc_feature (35)..(35): n can be any targeting portion (V) described herein
  misc_feature (36)..(36): n can be any third portion (D) described herein
gauuuagaaccccaaaaacgaaggggacuaaaacnn

SEQ ID NO: 991 - DNA, 36 bp, Artificial Sequence
  Synthetic construct
  misc_feature (35)..(35): n can be any targeting portion (V) described herein
  misc_feature (36)..(36): n can be any third portion (D) described herein
gatttagaaccccaaaaacgaaggggactaaaacnn

SEQ ID NO: 992 - DNA, 38 bp, Artificial Sequence
  Synthetic construct
  misc_feature (37)..(37): n can be any targeting portion (V) described herein
  misc_feature (38)..(38): n can be any third portion (D) described herein
guaagagacuaccucuauaugaaagaggacuaaaacnn

SEQ ID NO: 993 - DNA, 38 bp, Artificial Sequence
  Synthetic construct
  misc_feature (37)..(37): n can be any targeting portion (V) described herein
  misc_feature (38)..(38): n can be any third portion (D) described herein
gtaagagactacctctatatgaaagaggactaaaacnn

SEQ ID NO: 994 - DNA, 31 bp, Artificial Sequence
  Synthetic construct
  misc_feature (30)..(30): n can be any targeting portion (V) described herein
  misc_feature (31)..(31): n can be any third portion (D) described herein
acuaccucuauaugaaagaggacuaaaacnn

SEQ ID NO: 995 - DNA, 31 bp, Artificial Sequence
  Synthetic construct
  misc_feature (30)..(30): n can be any targeting portion (V) described herein
  misc_feature (31)..(31): n can be any third portion (D) described herein
actacctctatatgaaagaggactaaaacnn

SEQ ID NO: 996 - DNA, 25 bp, Artificial Sequence
  Synthetic construct
  misc_feature (24)..(24): n can be any targeting portion (V) described herein
  misc_feature (25)..(25): n can be any third portion (D) described herein
gacuaccucuauaugaaagaggann

SEQ ID NO: 997 - DNA, 25 bp, Artificial Sequence
  Synthetic construct
  misc_feature (24)..(24): n can be any targeting portion (V) described herein
  misc_feature (25)..(25): n can be any third portion (D) described herein
gactacctctatatgaaagaggann

SEQ ID NO: 998 - DNA, 32 bp, Artificial Sequence
  Synthetic construct
  misc_feature (31)..(31): n can be any targeting portion (V) described herein
  misc_feature (32)..(32): n can be any third portion (D) described herein
gguaagagacuaccucuauaugaaagaggann

SEQ ID NO: 999 - DNA, 32 bp, Artificial Sequence
  Synthetic construct
  misc_feature (31)..(31): n can be any targeting portion (V) described herein
  misc_feature (32)..(32): n can be any third portion (D) described herein
ggtaagagactacctctatatgaaagaggann

SEQ ID NO: 1000 - DNA, 32 bp, Artificial Sequence
  Synthetic construct
  misc_feature (31)..(31): n can be any targeting portion (V) described herein
  misc_feature (32)..(32): n can be any third portion (D) described herein
ggauuuagaccaccccaaaaaugaaggggann

SEQ ID NO: 1001 - DNA, 32 bp, Artificial Sequence
  Synthetic construct
  misc_feature (31)..(31): n can be any targeting portion (V) described herein
  misc_feature (32)..(32): n can be any third portion (D) described herein
ggatttagaccaccccaaaaatgaaggggann

SEQ ID NO: 1002 - DNA, 25 bp, Artificial Sequence
  Synthetic construct
  misc_feature (24)..(24): n can be any targeting portion (V) described herein
  misc_feature (25)..(25): n can be any third portion (D) described herein
gaccaccccaaaaaugaaggggann

SEQ ID NO: 1003 - DNA, 25 bp, Artificial Sequence
  Synthetic construct
  misc_feature (24)..(24): n can be any targeting portion (V) described herein
  misc_feature (25)..(25): n can be any third portion (D) described herein
gaccaccccaaaaatgaaggggann

SEQ ID NO: 1004 - skipped

SEQ ID NO: 1005 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 1006 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 1007-1009 - skipped (3 entries)

SEQ ID NO: 1010 - DNA, 14 bp, Artificial Sequence
  Synthetic construct
guuguggaaggucc

SEQ ID NO: 1011 - DNA, 14 bp, Artificial Sequence
  Synthetic construct
gttgtggaaggtcc

SEQ ID NO: 1012 - DNA, 15 bp, Artificial Sequence
  Synthetic construct
guuggaacugcucuc

SEQ ID NO: 1013 - DNA, 15 bp, Artificial Sequence
  Synthetic construct
gttggaactgctctc

SEQ ID NO: 1014 - DNA, 36 bp, Artificial Sequence
  Synthetic construct
guuguggaagguccaguuuugggggcuauuacaaca

SEQ ID NO: 1015 - DNA, 36 bp, Artificial Sequence
  Synthetic construct
gttgtggaaggtccagttttgggggctattacaaca

SEQ ID NO: 1016 - DNA, 36 bp, Artificial Sequence
  Synthetic construct
guuggaacugcucucauuuuggaggguaaucacaac

SEQ ID NO: 1017 - DNA, 36 bp, Artificial Sequence
  Synthetic construct
gttggaactgctctcattttggagggtaatcacaac

SEQ ID NO: 1018 - DNA, 8 bp, Artificial Sequence
  Synthetic construct
aguuuugg

SEQ ID NO: 1019 - DNA, 8 bp, Artificial Sequence
  Synthetic construct
agttttgg

SEQ ID NO: 1020 - DNA, 6 bp, Artificial Sequence
  Synthetic construct
auuuug

SEQ ID NO: 1021 - DNA, 6 bp, Artificial Sequence
  Synthetic construct
attttg

SEQ ID NO: 1022 - DNA, 4 bp, Artificial Sequence
  Synthetic construct
aaaa

SEQ ID NO: 1023 - DNA, 14 bp, Artificial Sequence
  Synthetic construct
gggcuauuacaaca

SEQ ID NO: 1024 - DNA, 14 bp, Artificial Sequence
  Synthetic construct
gggctattacaaca

SEQ ID NO: 1025 - DNA, 15 bp, Artificial Sequence
  Synthetic construct
gaggguaaucacaac

SEQ ID NO: 1026 - DNA, 15 bp, Artificial Sequence
  Synthetic construct
gagggtaatcacaac

SEQ ID NO: 1027 - DNA, 40 bp, Artificial Sequence
  Synthetic construct
guuggaacugcucucauuuuauucgugaaguuuuuauuug

SEQ ID NO: 1028 - DNA, 40 bp, Artificial Sequence
  Synthetic construct
gttggaactgctctcattttattcgtgaagtttttatttg

SEQ ID NO: 1029 - DNA, 38 bp, Artificial Sequence
  Synthetic construct
guuggaacugcucucauuuuauucgugaguuuuuauug

SEQ ID NO: 1030 - DNA, 39 bp, Artificial Sequence
  Synthetic construct
gttggaactgctctcattttattcgtgagtttttatttg

SEQ ID NO: 1031 - DNA, 15 bp, Artificial Sequence
  Synthetic construct
guugcaucugccuuc

SEQ ID NO: 1032 - DNA, 15 bp, Artificial Sequence
  Synthetic construct
gttgcatctgccttc

SEQ ID NO: 1033 - DNA, 88 bp, Artificial Sequence
  Synthetic construct
guuggaacugcucucauuuuauucgugaaguuuuuauuuguuuucaaaggaacucaugaauacagaguauuuggaggguaauaacaac

SEQ ID NO: 1034 - DNA, 88 bp, Artificial Sequence
  Synthetic construct
gttggaactgctctcattttattcgtgaagtttttatttgttttcaaaggaactcatgaatacagagtatttggagggtaataacaac

SEQ ID NO: 1035 - DNA, 88 bp, Artificial Sequence
  Synthetic construct
guuggaacugcucucauuuuauucgugaguuuuuauuguuuuuucaaaggaacucaugaaugcaaagcauuuggaggguaaucacaac

SEQ ID NO: 1036 - DNA, 88 bp, Artificial Sequence
  Synthetic construct
gttggaactgctctcattttattcgtgagtttttattgttttttcaaaggaactcatgaatgcaaagcatttggagggtaatcacaac

SEQ ID NO: 1037 - DNA, 36 bp, Artificial Sequence
  Synthetic construct
guugcaucugccuucuuuuugaaagguaaaaacaac

SEQ ID NO: 1038 - DNA, 36 bp, Artificial Sequence
  Synthetic construct
gttgcatctgccttctttttgaaaggtaaaaacaac

SEQ ID NO: 1039 - DNA, 6 bp, Artificial Sequence
  Synthetic construct
uuuuuu

SEQ ID NO: 1040 - DNA, 6 bp, Artificial Sequence
  Synthetic construct
tttttt

SEQ ID NO: 1041 - DNA, 4 bp, Artificial Sequence
  Synthetic construct
uuuu

SEQ ID NO: 1042 - DNA, 4 bp, Artificial Sequence
  Synthetic construct
tttt

SEQ ID NO: 1043 - DNA, 44 bp, Artificial Sequence
  Synthetic construct
caaaggaacucaugaauacagaguauuuggaggguaauaacaac

SEQ ID NO: 1044 - DNA, 44 bp, Artificial Sequence
  Synthetic construct
caaaggaactcatgaatgcaaagcatttggagggtaatcacaac

SEQ ID NO: 1045 - DNA, 16 bp, Artificial Sequence
  Synthetic construct
gaaagguaaaaacaac

SEQ ID NO: 1046 - DNA, 16 bp, Artificial Sequence
  Synthetic construct
gaaaggtaaaaacaac

SEQ ID NO: 1047 - DNA, 38 bp, Artificial Sequence
  Synthetic construct
  misc_feature (1)..(1): n can be any third portion (D) described herein
  misc_feature (2)..(2): n can be any targeting portion (V) described herein
nnguuguggaagguccaguuuugggggcuauuacaaca

SEQ ID NO: 1048 - DNA, 38 bp, Artificial Sequence
  Synthetic construct
  misc_feature (1)..(1): n can be any third portion (D) described herein
  misc_feature (2)..(2): n can be any targeting portion (V) described herein
nngttgtggaaggtccagttttgggggctattacaaca

SEQ ID NO: 1049 - DNA, 38 bp, Artificial Sequence
  Synthetic construct
  misc_feature (1)..(1): n can be any third portion (D) described herein
  misc_feature (2)..(2): n can be any targeting portion (V) described herein
nnguuggaacugcucucauuuuggaggguaaucacaac

SEQ ID NO: 1050 - DNA, 38 bp, Artificial Sequence
  Synthetic construct
  misc_feature (1)..(1): n can be any third portion (D) described herein
  misc_feature (2)..(2): n can be any targeting portion (V) described herein
nngttggaactgctctcattttggagggtaatcacaac

SEQ ID NO: 1051 - DNA, 90 bp, Artificial Sequence
  Synthetic construct
  misc_feature (1)..(1): n can be any third portion (D) described herein
  misc_feature (2)..(2): n can be any targeting portion (V) described herein
nnguuggaacugcucucauuuuauucgugaaguuuuuauuuguuuucaaaggaacucaugaauacagaguauuuggaggguaauaacaac

SEQ ID NO: 1052 - DNA, 90 bp, Artificial Sequence
  Synthetic construct
  misc_feature (1)..(1): n can be any third portion (D) described herein
  misc_feature (2)..(2): n can be any targeting portion (V) described herein
nngttggaactgctctcattttattcgtgaagtttttatttgttttcaaaggaactcatgaatacagagtatttggagggtaataacaac

SEQ ID NO: 1053 - DNA, 90 bp, Artificial Sequence
  Synthetic construct
  misc_feature (1)..(1): n can be any third portion (D) described herein
  misc_feature (2)..(2): n can be any targeting portion (V) described herein
nnguuggaacugcucucauuuuauucgugaguuuuuauuguuuuuucaaaggaacucaugaaugcaaagcauuuggaggguaaucacaac

SEQ ID NO: 1054 - DNA, 90 bp, Artificial Sequence
  Synthetic construct
  misc_feature (1)..(1): n can be any third portion (D) described herein
  misc_feature (2)..(2): n can be any targeting portion (V) described herein
nngttggaactgctctcattttattcgtgagtttttattgttttttcaaaggaactcatgaatgcaaagcatttggagggtaatcacaac

SEQ ID NO: 1055 - DNA, 38 bp, Artificial Sequence
  Synthetic construct
  misc_feature (1)..(1): n can be any third portion (D) described herein
  misc_feature (2)..(2): n can be any targeting portion (V) described herein
nnguugcaucugccuucuuuuugaaagguaaaaacaac

SEQ ID NO: 1056 - DNA, 38 bp, Artificial Sequence
  Synthetic construct
  misc_feature (1)..(1): n can be any third portion (D) described herein
  misc_feature (2)..(2): n can be any targeting portion (V) described herein
nngttgcatctgccttctttttgaaaggtaaaaacaac

SEQ ID NO: 1057-1059 - skipped (3 entries)

SEQ ID NO: 1060 - protein, 954 aa, Eubacterium siraeum
MGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLRHWCVHSEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFRNTVCHLNAIRNININIKEIKEVENYFALYHYLIQKHLENRFADKKVERDTGDFISKLEEHKTYCKDFVKAYCTPFGYNLVRYKNLTIDGLFDKNYPGKDDSDEQK

SEQ ID NO: 1061 - protein, 954 aa, Eubacterium siraeum
MGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLAHWCVASEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFANTVCALNAIRNININIKEIKEVENYFALYHYLIQKHLENRFADKKVERDTGDFISKLEEHKTYCKDFVKAYCTPFGYNLVRYKNLTIDGLFDKNYPGKDDSDEQK

SEQ ID NO: 1062 - protein, 967 aa, Ruminococcus flavefaciens
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 1063 - protein, 972 aa, Ruminococcus flavefaciens
EASIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSG

SEQ ID NO: 1064 - protein, 946 aa, Anaerobic digester
MNNKRKTKAKAAGLKSVFFDQKQAVLTTFAKGNNSQIEKKVVNSEVKDLRQPPAFDLELKEKTFYISGKNNINTSRENPLASASLPLSKRQRIRAERIKRAREENRPYHNVKRVGEDDLRAKADLEKHYFGKEYSDNLKIQIIYNILDINKIISPYINDIVYSMNNLARNDEYIDGKIDVIGSLSSTTDYSSFMSPNKDLEKEKKFSFHRENYKKFVEASKPYMRYYGKVFIRDVKKSKLSTGKGEKIEVMYRSDEEIFTIFQILSYVRQSIMHNDIGNKSSILAIEKYPARFVGFLSDLLKTKTNDVNRMFIDNNSQTNFWVLFSIFGLQDHTSGADKICRNFYDFVIKADSKNLGFSLKKIRELMLDLPNANMLRDHQFDTVRSKFYTLLDFIIYQHYLEEKSRIDNMVEKLRMTLKEEEKEVLYAAEAKIVWNAIGAKVINKLVPMMNGDALKEIKRKNRDRKLPQSVIATVQVNSDANVFSGLIYFLTLFLDGKEINEMVSNLITKFENIDSLLHVDREIYKSDEKDLDLEIEKLALFFKGVVRPNAKTDTGAGEISKSFSIFQSAERIIEELKFIKNVTRMDNEIFPSEGVFLDAANVLGVRGDDFDFSNEFVGDDLHSDANKKIINKINGTKEDRNLRNFIINNVVKSRRFQYIARHMNTHYVKQLANNETLNRFVLNKMGDAKIINRYYESISGNTPNIEVRSQIDYLVKRLRSFSFEDLNDVKQKVRPGTNESIEKEKKKALVGLCLTIQYLVYKNLVNINARYTTAFYCLERDSKLKGFGVDVWRDFESYTALTNHFIKEGYLPVRKAEILRANLKHLDCEDGFKYYRNQVTHLNAIRVAYKYINEIKSVHSYFALYHYIMQRHLYDSLQAKAKDSSGFVIDALKKSFEHKIYSKDLLHVLHSPFGYNTARYKNLSIEALFDKNESRPEVNPLSTND

SEQ ID NO: 1065 - protein, 951 aa, Anaerobic digester
EASNNKRKTKAKAAGLKSVFFDQKQAVLTTFAKGNNSQIEKKVVNSEVKDLRQPPAFDLELKEKTFYISGKNNINTSRENPLASASLPLSKRQRIRAERIKRAREENRPYHNVKRVGEDDLRAKADLEKHYFGKEYSDNLKIQIIYNILDINKIISPYINDIVYSMNNLARNDEYIDGKIDVIGSLSSTTDYSSFMSPNKDLEKEKKFSFHRENYKKFVEASKPYMRYYGKVFIRDVKKSKLSTGKGEKIEVMYRSDEEIFTIFQILSYVRQSIMHNDIGNKSSILAIEKYPARFVGFLSDLLKTKTNDVNRMFIDNNSQTNFWVLFSIFGLQDHTSGADKICRNFYDFVIKADSKNLGFSLKKIRELMLDLPNANMLRDHQFDTVRSKFYTLLDFIIYQHYLEEKSRIDNMVEKLRMTLKEEEKEVLYAAEAKIVWNAIGAKVINKLVPMMNGDALKEIKRKNRDRKLPQSVIATVQVNSDANVFSGLIYFLTLFLDGKEINEMVSNLITKFENIDSLLHVDREIYKSDEKDLDLEIEKLALFFKGVVRPNAKTDTGAGEISKSFSIFQSAERIIEELKFIKNVTRMDNEIFPSEGVFLDAANVLGVRGDDFDFSNEFVGDDLHSDANKKIINKINGTKEDRNLRNFIINNVVKSRRFQYIARHMNTHYVKQLANNETLNRFVLNKMGDAKIINRYYESISGNTPNIEVRSQIDYLVKRLRSFSFEDLNDVKQKVRPGTNESIEKEKKKALVGLCLTIQYLVYKNLVNINARYTTAFYCLERDSKLKGFGVDVWRDFESYTALTNHFIKEGYLPVRKAEILRANLKHLDCEDGFKYYRNQVTHLNAIRVAYKYINEIKSVHSYFALYHYIMQRHLYDSLQAKAKDSSGFVIDALKKSFEHKIYSKDLLHVLHSPFGYNTARYKNLSIEALFDKNESRPEVNPLSTNDGSG

SEQ ID NO: 1066 - protein, 1034 aa, Unknown
  Synthetic construct
MKRQKTFAKRIGIKSTVAYGQGKYAITTFGKGSKAEIAVRSADPPEETLPTESDATLSIHAKFAKAGRDGREFKCGDVDETRIHTSRSEYESLISNPAESPREDYLGLKGTLERKFFGDEYPKDNLRIQIIYSILDIQKILGLYVEDILHFVDGLQDEPEDLVGLGLGDEKMQKLLSKALPYMGFFGSTDVFKVTKKREERAAADEHNAKVFRALGAIRQKLAHFKWKESLAIFGANANMPIRFFQGATGGRQLWNDVIAPLWKKRIERVRKSFLSNSAKNLWVLYQVFKDDTDEKKKARARQYYHFSVLKEGKNLGFNLTKTREYFLDKFFPIFHSSAPDVKRKVDTFRSKFYAILDFIIYEASVSVANSGQMGKVAPWKGAIDNALVKLREAPDEEAKEKIYNVLAASIRNDSLFLRLKSACDKFGAEQNRPVFPNELRNNRDIRNVRSEWLEATQDVDAAAFVQLIAFLCNFLEGKEINELVTALIKKFEGIQALIDLLRNLEGVDSIRFENEFALFNDDKGNMAGRIARQLRLLASVGKMKPDMTDAKRVLYKSALEILGAPPDEVSDEWLAENILLDKSNNDYQKAKKTVNPFRNYIAKNVITSRSFYYLVRYAKPTAVRKLMSNPKIVRYVLKRLPEKQVASYYSAIWTQSESNSNEMVKLIEMIDRLTTEIAGFSFAVLKDKKDSIVSASRESRAVNLEVERLKKLTTLYMSIAYIAVKSLVKVNARYFIAYSALERDLYFFNEKYGEEFRLHFIPYELNGKTCQFEYLAILKYYLARDEETLKRKCEICEEIKVGCEKHKKNANPPYEYDQEWIDKKKALNSERKACERRLHFSTHWAQYATKRDENMAKHPQKWYDILASHYDELLALQATGWLATQARNDAEHLNPVNEFDVYIEDLRRYPEGTPKNKDYHIGSYFEIYHYIRQRAYLEEVLAKRKEYRDSGSFTDEQLDKLQKILDDIRARGSYDKNLLKLEYLPFAYNLPRYKNLTTEALFDDDSVSGKKRVAEWREREKTREAEREQRRQR

SEQ ID NO: 1067-1069 - skipped (3 entries)

SEQ ID NO: 1070 - DNA, 15 bp, Artificial Sequence
  Synthetic construct
gaacuacacccgugc

SEQ ID NO: 1071 - DNA, 15 bp, Artificial Sequence
  Synthetic construct
gaactacacccgtgc

SEQ ID NO: 1072 - DNA, 9 bp, Artificial Sequence
  Synthetic construct
cacccgugc

SEQ ID NO: 1073 - DNA, 9 bp, Artificial Sequence
  Synthetic construct
cacccgtgc

SEQ ID NO: 1074 - DNA, 6 bp, Artificial Sequence
  Synthetic construct
aaaaau

SEQ ID NO: 1075 - DNA, 6 bp, Artificial Sequence
  Synthetic construct
aaaaat

SEQ ID NO: 1076 - DNA, 5 bp, Artificial Sequence
  Synthetic construct
aaaaa

SEQ ID NO: 1077 - DNA, 4 bp, Artificial Sequence
  Synthetic construct
aaaa

SEQ ID NO: 1078 - DNA, 15 bp, Artificial Sequence
  Synthetic construct
gcaggggucuaaaac

SEQ ID NO: 1079 - DNA, 15 bp, Artificial Sequence
  Synthetic construct
gcaggggtctaaaac

SEQ ID NO: 1080 - DNA, 36 bp, Artificial Sequence
  Synthetic construct
gaacuacacccgugcaaaaaugcaggggucuaaaac

SEQ ID NO: 1081 - DNA, 36 bp, Artificial Sequence
  Synthetic construct
gaactacacccgtgcaaaaatgcaggggtctaaaac

SEQ ID NO: 1082 - DNA, 30 bp, Artificial Sequence
  Synthetic construct
cacccgugcaaaaaugcaggggucuaaaac

SEQ ID NO: 1083 - DNA, 30 bp, Artificial Sequence
  Synthetic construct
cacccgtgcaaaaatgcaggggtctaaaac

SEQ ID NO: 1084 - DNA, 15 bp, Artificial Sequence
  Synthetic construct
caaguaaaccccuac

SEQ ID NO: 1085 - DNA, 15 bp, Artificial Sequence
  Synthetic construct
caagtaaacccctac

SEQ ID NO: 1086 - DNA, 11 bp, Artificial Sequence
  Synthetic construct
uaaaccccuac

SEQ ID NO: 1087 - DNA, 11 bp, Artificial Sequence
  Synthetic construct
taaacccctac

SEQ ID NO: 1088 - DNA, 9 bp, Artificial Sequence
  Synthetic construct
aaccccuac

SEQ ID NO: 1089 - DNA, 9 bp, Artificial Sequence
  Synthetic construct
aacccctac

SEQ ID NO: 1090 - DNA, 6 bp, Artificial Sequence
  Synthetic construct
caacug

SEQ ID NO: 1091 - DNA, 6 bp, Artificial Sequence
  Synthetic construct
caactg

SEQ ID NO: 1092 - DNA, 15 bp, Artificial Sequence
  Synthetic construct
gucgggguuugaaac

SEQ ID NO: 1093 - DNA, 15 bp, Artificial Sequence
  Synthetic construct
gtcggggtttgaaac

SEQ ID NO: 1094 - DNA, 9 bp, Artificial Sequence
  Synthetic construct
gucgggguu

SEQ ID NO: 1095 - DNA, 9 bp, Artificial Sequence
  Synthetic construct
gtcggggtt

SEQ ID NO: 1096 - DNA, 36 bp, Artificial Sequence
  Synthetic construct
caaguaaaccccuaccaacuggucgggguuugaaac

SEQ ID NO: 1097 - DNA, 36 bp, Artificial Sequence
  Synthetic construct
caagtaaacccctaccaactggtcggggtttgaaac

SEQ ID NO: 1098 - DNA, 32 bp, Artificial Sequence
  Synthetic construct
uaaaccccuaccaacuggucgggguuugaaac

SEQ ID NO: 1099 - DNA, 32 bp, Artificial Sequence
  Synthetic construct
taaacccctaccaactggtcggggtttgaaac

SEQ ID NO: 1100 - DNA, 30 bp, Artificial Sequence
  Synthetic construct
aaccccuaccaacuggucgggguuugaaac

SEQ ID NO: 1101 - DNA, 30 bp, Artificial Sequence
  Synthetic construct
aacccctaccaactggtcggggtttgaaac

SEQ ID NO: 1102 - DNA, 15 bp, Artificial Sequence
  Synthetic construct
gaccaacaccucugc

SEQ ID NO: 1103 - DNA, 15 bp, Artificial Sequence
  Synthetic construct
gaccaacacctctgc

SEQ ID NO: 1104 - DNA, 13 bp, Artificial Sequence
  Synthetic construct
ccaacaccucugc

SEQ ID NO: 1105 - DNA, 13 bp, Artificial Sequence
  Synthetic construct
ccaacacctctgc

SEQ ID NO: 1106 - DNA, 9 bp, Artificial Sequence
  Synthetic construct
caccucugc

SEQ ID NO: 1107 - DNA, 9 bp, Artificial Sequence
  Synthetic construct
cacctctgc

SEQ ID NO: 1108 - DNA, 6 bp, Artificial Sequence
  Synthetic construct
aaaacu

SEQ ID NO: 1109 - DNA, 6 bp, Artificial Sequence
  Synthetic construct
aaaact

SEQ ID NO: 1110 - DNA, 4 bp, Artificial Sequence
  Synthetic construct
aaaa

SEQ ID NO: 1111 - DNA, 15 bp, Artificial Sequence
  Synthetic construct
gcaggggucuaaaac

SEQ ID NO: 1112 - DNA, 15 bp, Artificial Sequence
  Synthetic construct
gcaggggtctaaaac

SEQ ID NO: 1113 - DNA, 12 bp, Artificial Sequence
  Synthetic construct
gcaggggucuaa

SEQ ID NO: 1114 - DNA, 12 bp, Artificial Sequence
  Synthetic construct
gcaggggtctaa

SEQ ID NO: 1115 - DNA, 36 bp, Artificial Sequence
  Synthetic construct
gaccaacaccucugcaaaacugcaggggucuaaaac

SEQ ID NO: 1116 - DNA, 36 bp, Artificial Sequence
  Synthetic construct
gaccaacacctctgcaaaactgcaggggtctaaaac

SEQ ID NO: 1117 - DNA, 30 bp, Artificial Sequence
  Synthetic construct
caccucugcaaaacugcaggggucuaaaac

SEQ ID NO: 1118 - DNA, 30 bp, Artificial Sequence
  Synthetic construct
cacctctgcaaaactgcaggggtctaaaac

SEQ ID NO: 1119 - DNA, 14 bp, Artificial Sequence
  Synthetic construct
gugagaagucuccu

SEQ ID NO: 1120 - DNA, 14 bp, Artificial Sequence
  Synthetic construct
gtgagaagtctcct

SEQ ID NO: 1121 - DNA, 11 bp, Artificial Sequence
  Synthetic construct
guagcaucucc

SEQ ID NO: 1122 - DNA, 11 bp, Artificial Sequence
  Synthetic construct
gtagcatctcc

SEQ ID NO: 1123 - DNA, 17 bp, Artificial Sequence
  Synthetic construct
gcuagggcuuguaggaa

SEQ ID NO: 1124 - DNA, 17 bp, Artificial Sequence
  Synthetic construct
gctagggcttgtaggaa

SEQ ID NO: 1125 - DNA, 17 bp, Artificial Sequence
  Synthetic construct
auuguaccauagcaagg

SEQ ID NO: 1126 - DNA, 17 bp, Artificial Sequence
  Synthetic construct
attgtaccatagcaagg

SEQ ID NO: 1127 - DNA, 4 bp, Artificial Sequence
  Synthetic construct
uaug

SEQ ID NO: 1128 - DNA, 4 bp, Artificial Sequence
  Synthetic construct
tatg

SEQ ID NO: 1129 - DNA, 6 bp, Artificial Sequence
  Synthetic construct
ccauaa

SEQ ID NO: 1130 - DNA, 6 bp, Artificial Sequence
  Synthetic construct
ccataa

SEQ ID NO: 1131 - DNA, 4 bp, Artificial Sequence
  Synthetic construct
uucc

SEQ ID NO: 1132 - DNA, 4 bp, Artificial Sequence
  Synthetic construct
ttcc

SEQ ID NO: 1133 - DNA, 4 bp, Artificial Sequence
  Synthetic construct
aauu

SEQ ID NO: 1134 - DNA, 4 bp, Artificial Sequence
  Synthetic construct
aatt

SEQ ID NO: 1135 - DNA, 12 bp, Artificial Sequence
  Synthetic construct
gggagaugcuac

SEQ ID NO: 1136 - DNA, 12 bp, Artificial Sequence
  Synthetic construct
gggagatgctac

SEQ ID NO: 1137 - DNA, 13 bp, Artificial Sequence
  Synthetic construct
ggagacuucucac

SEQ ID NO: 1138 - DNA, 13 bp, Artificial Sequence
  Synthetic construct
ggagacttctcac

SEQ ID NO: 1139 - DNA, 15 bp, Artificial Sequence
  Synthetic construct
uugcuaugguacaau

SEQ ID NO: 1140 - DNA, 15 bp, Artificial Sequence
  Synthetic construct
ttgctatggtacaat

SEQ ID NO: 1141 - DNA, 15 bp, Artificial Sequence
  Synthetic construct
ccuacaagcccuagc

SEQ ID NO: 1142 - DNA, 15 bp, Artificial Sequence
  Synthetic construct
cctacaagccctagc

SEQ ID NO: 1143 - DNA, 30 bp, Artificial Sequence
  Synthetic construct
gugagaagucuccuuauggggagaugcuac

SEQ ID NO: 1144 - DNA, 30 bp, Artificial Sequence
  Synthetic construct
gtgagaagtctccttatggggagatgctac

SEQ ID NO: 1145 - DNA, 30 bp, Artificial Sequence
  Synthetic construct
guagcaucuccccauaaggagacuucucac

SEQ ID NO: 1146 - DNA, 30 bp, Artificial Sequence
  Synthetic construct
gtagcatctccccataaggagacttctcac

SEQ ID NO: 1147 - DNA, 36 bp, Artificial Sequence
  Synthetic construct
gcuagggcuuguaggaauuccuugcuaugguacaau

SEQ ID NO: 1148 - DNA, 36 bp, Artificial Sequence
  Synthetic construct
gctagggcttgtaggaattccttgctatggtacaat

SEQ ID NO: 1149 - DNA, 36 bp, Artificial Sequence
  Synthetic construct
auuguaccauagcaaggaauuccuacaagcccuagc

SEQ ID NO: 1150 - DNA, 36 bp, Artificial Sequence
  Synthetic construct
attgtaccatagcaaggaattcctacaagccctagc

SEQ ID NO: 1151 - DNA, 38 bp, Artificial Sequence
  Synthetic construct
  misc_feature (37)..(37): n can be any targeting portion (V) described herein
  misc_feature (38)..(38): n can be any third portion (D) described herein
gaacuacacccgugcaaaaaugcaggggucuaaaacnn

SEQ ID NO: 1152 - DNA, 38 bp, Artificial Sequence
  Synthetic construct
  misc_feature (37)..(37): n can be any targeting portion (V) described herein
  misc_feature (38)..(38): n can be any third portion (D) described herein
gaactacacccgtgcaaaaatgcaggggtctaaaacnn

SEQ ID NO: 1153 - DNA, 32 bp, Artificial Sequence
  Synthetic construct
  misc_feature (31)..(31): n can be any targeting portion (V) described herein
  misc_feature (32)..(32): n can be any third portion (D) described herein
cacccgugcaaaaaugcaggggucuaaaacnn

SEQ ID NO: 1154 - DNA, 32 bp, Artificial Sequence
  Synthetic construct
  misc_feature (31)..(31): n can be any targeting portion (V) described herein
  misc_feature (32)..(32): n can be any third portion (D) described herein
cacccgtgcaaaaatgcaggggtctaaaacnn

SEQ ID NO: 1155 - DNA, 38 bp, Artificial Sequence
  Synthetic construct
  misc_feature (37)..(37): n can be any targeting portion (V) described herein
  misc_feature (38)..(38): n can be any third portion (D) described herein
caaguaaaccccuaccaacuggucgggguuugaaacnn

SEQ ID NO: 1156 - DNA, 38 bp, Artificial Sequence
  Synthetic construct
  misc_feature (37)..(37): n can be any targeting portion (V) described herein
  misc_feature (38)..(38): n can be any third portion (D) described herein
caagtaaacccctaccaactggtcggggtttgaaacnn

SEQ ID NO: 1157 - DNA, 34 bp, Artificial Sequence
  Synthetic construct
  misc_feature (33)..(33): n can be any targeting portion (V) described herein
  misc_feature (34)..(34): n can be any third portion (D) described herein
uaaaccccuaccaacuggucgggguuugaaacnn

SEQ ID NO: 1158 - DNA, 34 bp, Artificial Sequence
  Synthetic construct
  misc_feature (33)..(33): n can be any targeting portion (V) described herein
  misc_feature (34)..(34): n can be any third portion (D) described herein
taaacccctaccaactggtcggggtttgaaacnn

SEQ ID NO: 1159 - DNA, 32 bp, Artificial Sequence
  Synthetic construct
  misc_feature (31)..(31): n can be any targeting portion (V) described herein
  misc_feature (32)..(32): n can be any third portion (D) described herein
aaccccuaccaacuggucgggguuugaaacnn

SEQ ID NO: 1160 - DNA, 32 bp, Artificial Sequence
  Synthetic construct
  misc_feature (31)..(31): n can be any targeting portion (V) described herein
  misc_feature (32)..(32): n can be any third portion (D) described herein
aacccctaccaactggtcggggtttgaaacnn

SEQ ID NO: 1161 - DNA, 38 bp, Artificial Sequence
  Synthetic construct
  misc_feature (37)..(37): n can be any targeting portion (V) described herein
  misc_feature (38)..(38): n can be any third portion (D) described herein
gaccaacaccucugcaaaacugcaggggucuaaaacnn

SEQ ID NO: 1162 - DNA, 38 bp, Artificial Sequence
  Synthetic construct
  misc_feature (37)..(37): n can be any targeting portion (V) described herein
  misc_feature (38)..(38): n can be any third portion (D) described herein
gaccaacacctctgcaaaactgcaggggtctaaaacnn

SEQ ID NO: 1163 - DNA, 32 bp, Artificial Sequence
  Synthetic construct
  misc_feature (31)..(31): n can be any targeting portion (V) described herein
  misc_feature (32)..(32): n can be any third portion (D) described herein
caccucugcaaaacugcaggggucuaaaacnn

SEQ ID NO: 1164 - DNA, 32 bp, Artificial Sequence
  Synthetic construct
  misc_feature (31)..(31): n can be any targeting portion (V) described herein
  misc_feature (32)..(32): n can be any third portion (D) described herein
cacctctgcaaaactgcaggggtctaaaacnn

SEQ ID NO: 1165 - DNA, 32 bp, Artificial Sequence
  Synthetic construct
  misc_feature (31)..(31): n can be any targeting portion (V) described herein
  misc_feature (32)..(32): n can be any third portion (D) described herein
gugagaagucuccuuauggggagaugcuacnn

SEQ ID NO: 1166 - DNA, 32 bp, Artificial Sequence
  Synthetic construct
  misc_feature (31)..(31): n can be any targeting portion (V) described herein
  misc_feature (32)..(32): n can be any third portion (D) described herein
gtgagaagtctccttatggggagatgctacnn

SEQ ID NO: 1167 - DNA, 32 bp, Artificial Sequence
  Synthetic construct
  misc_feature (31)..(31): n can be any targeting portion (V) described herein
  misc_feature (32)..(32): n can be any third portion (D) described herein
guagcaucuccccauaaggagacuucucacnn

SEQ ID NO: 1168 - DNA, 32 bp, Artificial Sequence
  Synthetic construct
  misc_feature (31)..(31): n can be any targeting portion (V) described herein
  misc_feature (32)..(32): n can be any third portion (D) described herein
gtagcatctccccataaggagacttctcacnn

SEQ ID NO: 1169 - DNA, 38 bp, Artificial Sequence
  Synthetic construct
  misc_feature (37)..(37): n can be any targeting portion (V) described herein
  misc_feature (38)..(38): n can be any third portion (D) described herein
gcuagggcuuguaggaauuccuugcuaugguacaaunn

SEQ ID NO: 1170 - DNA, 38 bp, Artificial Sequence
  Synthetic construct
  misc_feature (37)..(37): n can be any targeting portion (V) described herein
  misc_feature (38)..(38): n can be any third portion (D) described herein
gctagggcttgtaggaattccttgctatggtacaatnn

SEQ ID NO: 1171 - DNA, 38 bp, Artificial Sequence
  Synthetic construct
  misc_feature (37)..(37): n can be any targeting portion (V) described herein
  misc_feature (38)..(38): n can be any third portion (D) described herein
auuguaccauagcaaggaauuccuacaagcccuagcnn

SEQ ID NO: 1172 - DNA, 38 bp, Artificial Sequence
  Synthetic construct
  misc_feature (37)..(37): n can be any targeting portion (V) described herein
  misc_feature (38)..(38): n can be any third portion (D) described herein
attgtaccatagcaaggaattcctacaagccctagcnn

SEQ ID NO: 1173-1174 - skipped (2 entries)

SEQ ID NO: 1175 - protein, 500 aa, Unknown
  Synthetic construct
MEVQKTVMKTLSLRILRPLYSQEIEKEIKEEKERRKQAGGTGELDGGFYKKLEKKHSEMFSFDRLNLLLNQLQREIAKVYNHAISELYIATIAQGNKSNKHYISSIVYNRAYGYFYNAYIALGICSKVEANFRSNELLTQQSALPTAKSDNFPIVLHKQKGAEGEDGGFRISTEGSDLIFEIPIPFYEYNGENRKEPYKWVKKGGQKPVLKLILSTFRRQRNKGWAKDEGTDAEIRKVTEGKYQVSQIEINRGKKLGEHQKWFANFSIEQPIYERKPNRSIVGGLDVGIRSPLVCAINNSFSRYSVDSNDVFKFSKQVFAFRRRLLSKNSLKRKGHGAAHKLEPITEMTEKNDKFRKKIIERWAKEVTNFFVKNQVGIVQIEDLSTMKDREDHFFNQYLRGFWPYYQMQTLIENKLKEYGIEVKRVQAKYTSQLCSNPNCRYWNNYFNFEYRKVNKFPKFKCEKCNLEISADYNAARNLSTPDIEKFVAKATKGINLPEK

SEQ ID NO: 1176 - protein, 507 aa, Unknown
  Synthetic construct
MEEAKTVSKTLSLRILRPLYSAEIEKEIKEEKERRKQGGKSGELDSGFYKKLEKKHTQMFGWDKLNLMLSQLQRQIARVFNQSISELYIETVIQGKKSNKHYTSKIVYNRAYSVFYNAYLALGITSKVEANFRSTELLMQKSSLPTAKSDNFPILLHKQKGVEGEEGGFKISADGNDLIFEIPIPFYEYDSANKKEPFKWIKKGGQKPTIKLILSTFRRQRNKGWAKDEGTDAEIRKVIEGKYQVSHIEINRGKKLGDHQKWFVNFTIEQPIYERKLDKNIIGGIDVGIKSPLVCAVNNSFARYSVDSNDVLKFSKQAFAFRRRLLSKNSLKRSGHGSKNKLDPITRMTEKNDRFRKKIIERWAKEVTNFFIKNQVGTVQIEDLSTMKDRQDNFFNQYLRGFWPYYQMQNLIENKLKEYGIETKRIKARYTSQLCSNPSCRHWNSYFSFDHRKTNNFPKFKCEKCALEISADYNAARNISTPDIEKFVAKATKGINLPDKNENVILE

SEQ ID NO: 1177 - protein, 529 aa, Unknown
  Synthetic construct
MAKNTITKTLKLRIVRPYNSAEVEKIVADEKNNREKIALEKNKDKVKEACSKHLKVAAYCTTQVERNACLFCKARKLDDKFYQKLRGQFPDAVFWQEISEIFRQLQKQAAEIYNQSLIELYYEIFIKGKGIANASSVEHYLSDVCYTRAAELFKNAAIASGLRSKIKSNFRLKELKNMKSGLPTTKSDNFPIPLVKQKGGQYTGFEISNHNSDFIIKIPFGRWQVKKEIDKYRPWEKFDFEQVQKSPKPISLLLSTQRRKRNKGWSKDEGTEAEIKKVMNGDYQTSYIEVKRGSKIGEKSAWMLNLSIDVPKIDKGVDPSIIGGIDVGVKSPLVCAINNAFSRYSISDNDLFHFNKKMFARRRILLKKNRHKRAGHGAKNKLKPITILTEKSERFRKKLIERWACEIADFFIKNKVGTVQMENLESMKRKEDSYFNIRLRGFWPYAEMQNKIEFKLKQYGIEIRKVAPNNTSKTCSKCGHLNNYFNFEYRKKNKFPHFKCEKCNFKENADYNAALNISNPKLKSTKEEP

SEQ ID NO: 1178-1179 - skipped (2 entries)

SEQ ID NO: 1180 - DNA, 140 bp, Artificial Sequence
  Synthetic construct
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuu

SEQ ID NO: 1181 - DNA, 140 bp, Artificial Sequence
  Synthetic construct
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcattt

SEQ ID NO: 1182 - DNA, 143 bp, Artificial Sequence
  Synthetic construct
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuc

SEQ ID NO: 1183 - DNA, 143 bp, Artificial Sequence
  Synthetic construct
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttc

SEQ ID NO: 1184 - DNA, 161 bp, Artificial Sequence
  Synthetic construct
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaa

SEQ ID NO: 1185 - DNA, 161 bp, Artificial Sequence
  Synthetic construct
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcctctccaattctgcacaa

SEQ ID NO: 1186 - DNA, 139 bp, Artificial Sequence
  Synthetic construct
uucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuu

SEQ ID NO: 1187 - DNA, 139 bp, Artificial Sequence
  Synthetic construct
ttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcattt

SEQ ID NO: 1188 - DNA, 142 bp, Artificial Sequence
  Synthetic construct
uucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuc

SEQ ID NO: 1189 - DNA, 142 bp, Artificial Sequence
  Synthetic construct
ttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttc

SEQ ID NO: 1190 - DNA, 139 bp, Artificial Sequence; identical to SEQ ID NO: 1186
  Synthetic construct

SEQ ID NO: 1191 - DNA, 139 bp, Artificial Sequence; identical to SEQ ID NO: 1187
  Synthetic construct

SEQ ID NO: 1192 - DNA, 4 bp, Artificial Sequence
  Synthetic construct
gaaa

SEQ ID NO: 1193 - DNA, 4 bp, Artificial Sequence
  Synthetic construct
aaaa

SEQ ID NO: 1194 - DNA, 17 bp, Artificial Sequence
  Synthetic construct
gaaugaaggaaugcaac

SEQ ID NO: 1195 - DNA, 17 bp, Artificial Sequence
  Synthetic construct
gaatgaaggaatgcaac

SEQ ID NO: 1196 - DNA, 20 bp, Artificial Sequence
  Synthetic construct
gacgaaugaaggaaugcaac

SEQ ID NO: 1197 - DNA, 20 bp, Artificial Sequence
  Synthetic construct
gacgaatgaaggaatgcaac

SEQ ID NO: 1198 - DNA, 37 bp, Artificial Sequence
  Synthetic construct
guugcagaacccgaauagacgaaugaaggaaugcaac

SEQ ID NO: 1199 - DNA, 37 bp, Artificial Sequence
  Synthetic construct
gttgcagaacccgaatagacgaatgaaggaatgcaac

SEQ ID NO: 1200 - DNA, 163 bp, Artificial Sequence
  Synthetic construct
  misc_feature (162)..(162): n can be any targeting portion (V) described herein
  misc_feature (163)..(163): n can be any third portion (D) described herein
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttaaaagaatgaaggaatgcaacnn

SEQ ID NO: 1201 - DNA, 163 bp, Artificial Sequence
  Synthetic construct
  misc_feature (162)..(162): n can be any targeting portion (V) described herein
  misc_feature (163)..(163): n can be any third portion (D) described herein
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuaaaagaaugaaggaaugcaacnn

SEQ ID NO: 1202 - DNA, 163 bp, Artificial Sequence
  Synthetic construct
  misc_feature (162)..(162): n can be any targeting portion (V) described herein
  misc_feature (163)..(163): n is a, c, g, t or u
  misc_feature (1623)..(163): n can be any third portion (D) described herein
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttgaaagaatgaaggaatgcaacnn

SEQ ID NO: 1203 - DNA, 163 bp, Artificial Sequence
  Synthetic construct
  misc_feature (162)..(162): n can be any targeting portion (V) described herein
  misc_feature (163)..(163): n can be any third portion (D) described herein
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuugaaagaaugaaggaaugcaacnn

SEQ ID NO: 1204 - DNA, 169 bp, Artificial Sequence
  Synthetic construct
  misc_feature (168)..(168): n can be any targeting portion (V) described herein
  misc_feature (169)..(169): n can be any third portion (D) described herein
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcaaaagacgaatgaaggaatgcaacnn

SEQ ID NO: 1205 - DNA, 169 bp, Artificial Sequence
  Synthetic construct
  misc_feature (168)..(168): n can be any targeting portion (V) described herein
  misc_feature (169)..(169): n can be any third portion (D) described herein
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuucaaaagacgaaugaaggaaugcaacnn

SEQ ID NO: 1206 - DNA, 169 bp, Artificial Sequence
  Synthetic construct
  misc_feature (168)..(168): n can be any targeting portion (V) described herein
  misc_feature (169)..(169): n can be any third portion (D) described herein
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcgaaagacgaatgaaggaatgcaacnn

SEQ ID NO: 1207 - DNA, 169 bp, Artificial Sequence
  Synthetic construct
  misc_feature (168)..(168): n can be any targeting portion (V) described herein
  misc_feature (169)..(169): n can be any third portion (D) described herein
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuucgaaagacgaaugaaggaaugcaacnn

SEQ ID NO: 1208 - DNA, 204 bp, Artificial Sequence
  Synthetic construct
  misc_feature (203)..(203): n can be any targeting portion (V) described herein
  misc_feature (204)..(204): n can be any third portion (D) described herein
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcctctccaattctgcacaaaaaagttgcagaacccgaatagacgaatgaaggaatgcaacnn

SEQ ID NO: 1209 - DNA, 204 bp, Artificial Sequence
  Synthetic construct
  misc_feature (203)..(203): n can be any targeting portion (V) described herein
  misc_feature (204)..(204): n can be any third portion (D) described herein
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaaaaaaguugcagaacccgaauagacgaaugaaggaaugcaacnn

SEQ ID NO: 1210 - DNA, 204 bp, Artificial Sequence
  Synthetic construct
  misc_feature (203)..(203): n can be any targeting portion (V) described herein
  misc_feature (204)..(204): n can be any third portion (D) described herein
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcctctccaattctgcacaagaaagttgcagaacccgaatagacgaatgaaggaatgcaacnn

SEQ ID NO: 1211 - DNA, 204 bp, Artificial Sequence
  Synthetic construct
  misc_feature (203)..(203): n can be any targeting portion (V) described herein
  misc_feature (204)..(204): n can be any third portion (D) described herein
cuucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuuccucuccaauucugcacaagaaaguugcagaacccgaauagacgaaugaaggaaugcaacnn

SEQ ID NO: 1212 - DNA, 162 bp, Artificial Sequence
  Synthetic construct
  misc_feature (161)..(161): n can be any targeting portion (V) described herein
  misc_feature (162)..(162): n can be any third portion (D) described herein
ttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttaaaagaatgaaggaatgcaacnn

SEQ ID NO: 1213 - DNA, 162 bp, Artificial Sequence
  Synthetic construct
  misc_feature (161)..(161): n can be any targeting portion (V) described herein
  misc_feature (162)..(162): n can be any third portion (D) described herein
uucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuaaaagaaugaaggaaugcaacnn

SEQ ID NO: 1214 - DNA, 162 bp, Artificial Sequence
  Synthetic construct
  misc_feature (161)..(161): n can be any targeting portion (V) described herein
  misc_feature (162)..(162): n can be any third portion (D) described herein
ttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttgaaagaatgaaggaatgcaacnn

SEQ ID NO: 1215 - DNA, 162 bp, Artificial Sequence
  Synthetic construct
  misc_feature (161)..(161): n can be any targeting portion (V) described herein
  misc_feature (162)..(162): n can be any third portion (D) described herein
uucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuugaaagaaugaaggaaugcaacnn

SEQ ID NO: 1216 - DNA, 168 bp, Artificial Sequence
  Synthetic construct
  misc_feature (167)..(167): n can be any targeting portion (V) described herein
  misc_feature (168)..(168): n can be any third portion (D) described herein
ttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcaaaagacgaatgaaggaatgcaacnn

SEQ ID NO: 1217 - DNA, 168 bp, Artificial Sequence
  Synthetic construct
  misc_feature (167)..(167): n can be any targeting portion (V) described herein
  misc_feature (168)..(168): n can be any third portion (D) described herein
uucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuucaaaagacgaaugaaggaaugcaacnn

SEQ ID NO: 1218 - DNA, 168 bp, Artificial Sequence
  Synthetic construct
  misc_feature (167)..(167): n can be any targeting portion (V) described herein
  misc_feature (168)..(168): n can be any third portion (D) described herein
ttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcgaaagacgaatgaaggaatgcaacnn

SEQ ID NO: 1219 - DNA, 168 bp, Artificial Sequence
  Synthetic construct
  misc_feature (167)..(167): n can be any targeting portion (V) described herein
  misc_feature (168)..(168): n can be any third portion (D) described herein
uucacugauaaaguggagaaccgcuucaccaaaagcugucccuuaggggauuagaacuugagugaaggugggcugcuugcaucagccuaaugucgagaagugcuuucuucggaaaguaacccucgaaacaaauucauuuuucgaaagacgaaugaaggaaugcaacnn

The invention claimed is:

1. A method for detecting nuclease activity, the method comprising:
    combining a target nuclease with a cleavage substrate and a synthetic guiding component, thereby providing a reaction mixture;
    incubating the reaction mixture, thereby providing an incubated reaction mixture;
    quenching the incubated reaction mixture under a denaturation condition configured to denature the target nuclease; and
    measuring a detectable signal, if any, arising from a reacted cleavage substrate;
    wherein the target nuclease is a Cas9 homolog or ortholog;
    wherein the cleavage substrate comprises a duplex having a target strand and a non-target strand, and wherein at least one of the target or non-target strand comprises a detectable label;
    wherein the target strand comprises a structure having formula (Ia) of 5'-X-Y-T-Z-3' or formula (Ib) of 5'-Z-T-Y-X-3' or a salt thereof, wherein:
    X is a first binding region comprising a nucleic acid sequence,
    Y is a protospacer adjacent motif-binding region comprising a nucleic acid sequence configured to bind to a protospacer adjacent motif in the non-target strand,
    T is a target site comprising a nucleic acid sequence configured to bind to a targeting portion of the synthetic guiding component, and
    Z is a second binding region comprising a nucleic acid sequence; and
    wherein the non-target strand comprises a structure having formula (IIa) of 5'-A-U-B-C-3' or formula (IIb) of 5'-C-B-U-A-3' or a salt thereof, wherein:
    A is a third binding region comprising a nucleic acid sequence configured to bind to Z or a portion thereof,
    U is a complementary target site comprising a nucleic acid sequence configured to bind T or a portion thereof,
    B is the protospacer adjacent motif configured to interact with the target nuclease, and
    C is a fourth binding region comprising a nucleic acid sequence configured to bind X or a portion thereof,
    wherein the synthetic guiding component is configured to interact with the target nuclease, and wherein the cleavage substrate is configured to interact with the synthetic guiding component;
    wherein the synthetic guiding component comprises a structure having formula (IIIa) of 5'-D-V-E-L-F-3' or formula (IIIb) of 5'-F-L-E-V-D-3' or a salt thereof, wherein:
    D is an optional third portion comprising a nucleic acid sequence of from 1 to 20 nucleic acids;
    V is a targeting portion comprising a nucleic acid sequence configured to bind to a target site of the cleavage substrate;
    E is a first portion comprising a nucleic acid sequence configured to interact with a nuclease configured to bind and/or cleave the cleavage substrate;
    L is a linker; and
    F is a second portion comprising a nucleic acid sequence configured to interact with the target nuclease and E or a portion thereof;
    E comprises a nucleic acid sequence having at least 90% sequence identity to any one of SEQ ID NOs: 150-159, 184-189, 213-220, 249-264, 282-287, 308-311, 331-336, 445-462, 485-496, 520-535, 610-627, 640-645, 664-671, 716-721, 729-734, 740-745, 753-756, 765-770, 779-784, 795-800, 845-852, 861-862, 871-878, 923-931, 940-946, 958-968, 975-981, 1010-1017, 1027-1038, 1078-1083, 1092-1101, 1111-1118, 1135-1150, and 1194-1199;

L comprises a nucleic acid sequence having at least 90% sequence identity to any one of SEQ ID NOs: 160-165, 190-195, 221-227, 265-270, 288-294, 312-317, 337-341, 435-444, 475-484, 508-519, 595-609, 634-639, 658-663, 713-715, 726-728, 737-739, 749-752, 761-764, 775-778, 791-794, 841-844, 857-860, 867-870, 919-922, 937-939, 955-957, 972-974, 1018-1022, 1039-1042, 1074-1077, 1090-1091, 1108-1110, 1127-1134, and 1192-1193; and F comprises a nucleic acid sequence having at least 90% sequence identity to any one of SEQ ID NOs: 166-183, 196-212, 228-248, 271-281, 295-307, 318-330, 342-349, 425-434, 463-474, 498-507, 580-594, 628-633, 646-657, 710-712, 722-725, 735-736, 746-748, 757-760, 771-774, 785-790, 825-840, 853-856, 863-866, 915-918, 932-936, 947-954, 969-971, 1023-1026, 1043-1046, 1070-1073, 1084-1089, 1102-1107, 1119-1126, and 1180-1191.

2. The method of claim 1, wherein X has a length of from 2 to about 40 nucleotides, Y has a length of from 1 to 10 nucleotides, T has a length of from about 10 to about 30 nucleotides, Z has a length of from about 10 to about 40 nucleotides, A has a length of from about 10 to about 40 nucleotides, U has a length of from about 10 to about 30 nucleotides, B has a length of from 1 to 10 nucleotides, and C has a length of from 1 to about 40 nucleotides.

3. The method of claim 2, wherein X is longer than C.

4. The method of claim 1, wherein the target strand comprises a nucleic acid sequence having at least 80% sequence identity to any one of SEQ ID NOs: 1, 3, 5, 7, and 388-399 or a complement of any of these.

5. The method of claim 1, wherein:
X comprises a nucleic acid sequence having at least 80% sequence identity to any one of SEQ ID NOs: 20-30, or a complement of any of these;
Y comprises a nucleic acid sequence having at least 80% sequence identity to any one of SEQ ID NOs: 31-33, or a complement of any of these; and
Z comprises a nucleic acid sequence having at least 80% sequence identity to any one of SEQ ID NOs: 34-38, or a complement of any of these.

6. The method of claim 1, wherein the non-target strand comprises a nucleic acid sequence having at least 80% sequence identity to any one of SEQ ID NOs: 2, 4, 6, 8, and 400-417 or a complement of any of these.

7. The method of claim 1, wherein:
A comprises a nucleic acid sequence having at least 80% sequence identity to any one of SEQ ID NOs: 39-43, or a complement of any of these;
B comprises a nucleic acid sequence having at least 80% sequence identity to any one of SEQ ID NOs: 44-46, or a complement of any of these; and
C comprises a nucleic acid sequence having at least 80% sequence identity to any one of SEQ ID NOs: 47-55 and 57-58, or a complement of any of these.

8. The method of claim 1, wherein the target strand comprises a fluorescent label at the 5'-end and wherein the non-target strand comprises a quencher label at the 3'-end.

9. The method of claim 1, wherein the target strand does not include the detectable label, and wherein the non-target strand comprises an internal fluorescent label, an optional internal quencher label, and a quencher label at the 3'-end.

10. The method of claim 1, wherein the synthetic guiding component comprises a nucleic acid sequence having at least 80% sequence identity to any one of SEQ ID NOs: 9-12, 350-387, 537-564, 672-699, 801-814, 879-902, 982-1003, 1047-1056, 1151-1172, and 1200-1219 or a complement of any of these.

11. The method of claim 1, wherein D, if present, has a length of 1 to about 20 nucleotides, V has a length of from about 10 to about 30 nucleotides, E has a length of from about 10 to about 40 nucleotides, L has a length of 1 to about 10 nucleotides, and F has a length of from about 10 to about 100 nucleotides.

12. The method of claim 1, wherein the target nuclease is a Cas9 protein.

13. The method of claim 12, wherein the target nuclease comprises an amino acid sequence having at least 80% sequence identity to any one of SEQ ID NOs:100-105, 110-126, 420-422, 570-573, 700-707, 820-822, 910-913, 1005-1006, 1060-1066, and 1175-1177.

14. The method of claim 1, wherein the reaction mixture further comprises a nuclease buffer.

15. The method of claim 1, wherein the incubating step occurs at an ambient temperature.

16. The method of claim 1, wherein the denaturation condition includes an elevated temperature of from about 60° C. to about 100° C.

17. A method for detecting nuclease activity, the method comprising:
combining a target nuclease with a cleavage substrate and a synthetic guiding component, thereby providing a reaction mixture;
incubating the reaction mixture, thereby providing an incubated reaction mixture;
quenching the incubated reaction mixture under a denaturation condition configured to denature the target nuclease; and
measuring a detectable signal, if any, arising from a reacted cleavage substrate;
wherein the target nuclease is a SpyCas9 enzyme and the synthetic guiding component is an sgRNA configured to interact with the target nuclease;
wherein the method is conducted in a high throughput format.

18. The method of claim 17, wherein the synthetic guiding component comprises a structure having formula (IIIa) of 5'-D-V-E-L-F-3' or formula (IIIb) of 5'-F-L-E-V-D-3' or a salt thereof, wherein:
D is an optional third portion comprising a nucleic acid sequence of from 1 to 20 nucleic acids;
V is a targeting portion comprising a nucleic acid sequence configured to bind to a target site of the cleavage substrate;
E is a first portion comprising a nucleic acid sequence configured to interact with a nuclease configured to bind and/or cleave the cleavage substrate;
L is a linker; and
F is a second portion comprising a nucleic acid sequence configured to interact with the target nuclease and E or a portion thereof.

19. The method of claim 18, wherein the cleavage substrate comprises a duplex having a target strand and a non-target strand;
wherein the target strand comprises a structure having formula (Ia) of 5'-X-Y-T-Z-3' or formula (Ib) of 5'-Z-T-Y-X-3' or a salt thereof, wherein:
X is a first binding region comprising a nucleic acid sequence,
Y is a protospacer adjacent motif-binding region comprising a nucleic acid sequence configured to bind to a protospacer adjacent motif in the non-target strand, T is a target site comprising a nucleic acid sequence configured to bind to a targeting portion of the synthetic guiding component, and Z is a second binding region comprising a nucleic acid sequence.

20. The method of claim 19, wherein the non-target strand comprises a structure having formula (IIa) of 5'-A-U-B-C-3' or formula (IIb) of 5'-C-B-U-A-3' or a salt thereof, wherein:

A is a third binding region comprising a nucleic acid sequence configured to bind to Z or a portion thereof, U is a complementary target site comprising a nucleic acid sequence configured to bind T or a portion thereof, B is the protospacer adjacent motif configured to interact with the target nuclease, and C is a fourth binding region comprising a nucleic acid sequence configured to bind X or a portion thereof.

21. The method of claim 13, wherein the synthetic guiding component comprises a nucleic acid sequence having at least 95% sequence identity to any one of SEQ ID NOs: 9-12, 350-387, 537-564, 672-699, 801-814, 879-902, 982-1003, 1047-1056, 1151-1172, and 1200-1219; and wherein the target strand comprises a nucleic acid sequence having at least 80% sequence identity to any one of SEQ ID NOs: 1, 3, 5, 7, and 388-399 wherein the non-target strand comprises a nucleic acid sequence having at least 80% sequence identity to any one of SEQ ID NOs: 2, 4, 6, 8, and 400-417.

22. The method of claim 1, wherein

X comprises a nucleic acid sequence having at least 80% sequence identity to any one of SEQ ID NOs: 20-30;

Y comprises a nucleic acid sequence having at least 80% sequence identity to any one of SEQ ID NOs: 31-33; and Z comprises a nucleic acid sequence having at least 80% sequence identity to any one of SEQ ID NOs: 34-38.

23. The method of claim 22, wherein the target nuclease comprises an amino acid sequence having at least 80% sequence identity to any one of SEQ ID NOs:100-105, 110-126, 420-422, 570-573, 700-707, 820-822, 910-913, 1005-1006, 1060-1066, and 1175-1177.

24. The method of claim 17, wherein the cleavage substrate is a Cas9 inhibitor.

* * * * *